US010544420B2

(12) United States Patent
Smolke et al.

(10) Patent No.: US 10,544,420 B2
(45) Date of Patent: Jan. 28, 2020

(54) ENGINEERED BENZYLISOQUINOLINE ALKALOID EPIMERASES AND METHODS OF PRODUCING BENZYLISOQUINOLINE ALKALOIDS

(71) Applicant: Antheia, Inc., Menlo Park, CA (US)

(72) Inventors: Christina D. Smolke, Menlo Park, CA (US); Derek H. Wells, Palo Alto, CA (US)

(73) Assignee: Antheia, Inc., Menlo Park, CA (US)

( * ) Notice: Subject to any disclaimer, the term of this patent is extended or adjusted under 35 U.S.C. 154(b) by 0 days.

(21) Appl. No.: 16/149,025

(22) Filed: Oct. 1, 2018

(65) Prior Publication Data

US 2019/0078100 A1 Mar. 14, 2019

Related U.S. Application Data

(63) Continuation of application No. PCT/US2018/045222, filed on Aug. 3, 2018.

(60) Provisional application No. 62/541,038, filed on Aug. 3, 2017.

(51) Int. Cl.
| | |
|---|---|
| *C12N 15/22* | (2006.01) |
| *C12N 9/06* | (2006.01) |
| *C12P 17/18* | (2006.01) |
| *C12P 17/12* | (2006.01) |
| *C12N 15/62* | (2006.01) |
| *C12N 9/02* | (2006.01) |
| *C12N 9/90* | (2006.01) |
| *C12N 15/52* | (2006.01) |

(52) U.S. Cl.
CPC .......... *C12N 15/52* (2013.01); *C12N 9/0014* (2013.01); *C12N 9/0026* (2013.01); *C12N 9/0071* (2013.01); *C12N 9/90* (2013.01); *C12P 17/12* (2013.01); *C12P 17/18* (2013.01); *C12Y 105/01027* (2013.01); *C12Y 114/19* (2013.01); *C12Y 501/01* (2013.01)

(58) Field of Classification Search
CPC ........ C12N 15/52; C12N 9/90; C12N 9/0014; C12Y 501/01
See application file for complete search history.

(56) References Cited

U.S. PATENT DOCUMENTS

| | | | |
|---|---|---|---|
| 7,037,674 | B1 | 5/2006 | Kutchan et al. |
| 7,045,290 | B2 | 5/2006 | Lindquist et al. |
| 7,193,127 | B1 | 3/2007 | Kutchan et al. |
| 7,390,642 | B2 | 6/2008 | Kutchan et al. |
| 7,514,251 | B2 | 4/2009 | Kutchan et al. |
| 7,767,428 | B2 | 8/2010 | Kutchan et al. |
| 8,318,474 | B1 | 11/2012 | Smolke et al. |
| 8,710,226 | B2 | 4/2014 | Patel et al. |
| 8,735,111 | B2 | 5/2014 | Vanhercke et al. |
| 8,975,063 | B2 | 3/2015 | Smolke et al. |
| 8,993,280 | B2 | 3/2015 | Sato et al. |
| 9,200,261 | B2 | 12/2015 | Winzer et al. |
| 9,322,039 | B2 | 4/2016 | Smolke et al. |
| 9,376,696 | B1 | 6/2016 | Smolke et al. |
| 9,447,444 | B2 | 9/2016 | Winzer et al. |
| 9,458,481 | B2 | 10/2016 | Winzer et al. |
| 9,534,241 | B2 | 1/2017 | Smolke et al. |
| 9,725,732 | B2 | 8/2017 | Winzer et al. |
| 9,862,979 | B2 | 1/2018 | Winzer et al. |
| 9,926,329 | B2 | 3/2018 | Huntley et al. |
| 10,006,010 | B2 * | 6/2018 | Winzer ............... C12N 9/0071 |
| 10,017,799 | B2 | 7/2018 | Smolke et al. |
| 2004/0038352 | A1 | 2/2004 | Maier |
| 2005/0106588 | A1 | 5/2005 | Kutchan et al. |
| 2005/0139490 | A1 | 6/2005 | Chou et al. |
| 2005/0277179 | A1 | 12/2005 | Takai et al. |
| 2006/0185032 | A1 | 8/2006 | Kutchan et al. |
| 2007/0199090 | A1 | 8/2007 | Apuya et al. |
| 2008/0102499 | A1 | 5/2008 | Templeton et al. |
| 2008/0176754 | A1 | 7/2008 | Smolke et al. |
| 2008/0196123 | A1 | 8/2008 | Kutchan et al. |
| 2010/0075385 | A1 | 3/2010 | Kutchan et al. |
| 2010/0184166 | A1 | 7/2010 | Sato et al. |
| 2013/0130340 | A1 | 5/2013 | Yan et al. |
| 2013/0340119 | A1 | 12/2013 | Plesch et al. |

(Continued)

FOREIGN PATENT DOCUMENTS

| | | |
|---|---|---|
| EP | 1512748 A1 | 3/2005 |
| EP | 1837396 A1 | 9/2007 |

(Continued)

OTHER PUBLICATIONS

Alcantara et al. "Sanguinarine Biosynthesis Is Associated with the Endoplasmic Reticulum in Cultured Opium Poppy Cells after Elicitor Treatment," Plant Physiology, 138 (Apr. 22, 2005): 173-183.

Allen et al., RNAi-Mediated Replacement of Morphine with the Nonnarcotic Alkaloid Reticuline in Opium Poppy. Nat. Biotechnol. 22 (2004): 1559-1566.

Avalos et al., Compartmentalization of Metabolic Pathways in Yeast Mitochondria Improves the Production of Branched-Chain Alcohols. Nat. Biotechnol. 31 (2013): 335-341.

Backes et al., Organization of Multiple Cytochrome P450s with NADPH-Cytochrome P450 Reductase in Membranes. Pharmacol. Ther. 98 (2003): 221-233.

(Continued)

*Primary Examiner* — Ganapathirama Raghu
(74) *Attorney, Agent, or Firm* — Wilson Sonsini Goodrich & Rosati

(57) ABSTRACT

The present disclosure provides systems and methods for increasing production of an alkaloid product through the epimerization of a (S)-1-benzylisoquinoline alkaloid to a (R)-1-benyzlisoquinoline alkaloid via an engineered epimerase in an engineered host cell. A (S)-1-benzylisoquinoline alkaloid is contacted with said engineered epimerase. Contacting said (S)-1-benzylisoquinoline alkaloid with said engineered epimerase converts said (S)-1-benzylisoquinoline alkaloid to said (R)-1-benzylisoquinoline alkaloid.

30 Claims, 30 Drawing Sheets

Specification includes a Sequence Listing.

(56) References Cited

U.S. PATENT DOCUMENTS

| | | |
|---|---|---|
| 2014/0013465 A1 | 1/2014 | Coombs et al. |
| 2014/0273109 A1 | 9/2014 | Smolke et al. |
| 2015/0267233 A1 | 9/2015 | Smolke et al. |
| 2016/0201101 A1 | 7/2016 | Facchini et al. |
| 2016/0304923 A1 | 10/2016 | Smolke et al. |
| 2016/0312256 A1 | 10/2016 | Facchini et al. |
| 2016/0319314 A1 | 11/2016 | Smolke et al. |
| 2016/0340704 A1 | 11/2016 | Martin et al. |
| 2017/0058305 A1 | 3/2017 | Facchini et al. |
| 2017/0130250 A1 | 5/2017 | Facchini et al. |
| 2017/0198299 A1 | 7/2017 | Winzer et al. |
| 2017/0267686 A1 | 9/2017 | Facchini et al. |
| 2017/0280647 A1 | 10/2017 | Fist et al. |
| 2017/0306301 A1 | 10/2017 | Martin et al. |
| 2017/0362617 A1 | 12/2017 | Peralta-Yahya et al. |
| 2018/0163212 A1 | 6/2018 | Smolke et al. |
| 2018/0163241 A1 | 6/2018 | Smolke et al. |
| 2018/0251801 A1 | 9/2018 | Aharoni et al. |
| 2019/0100781 A1 | 4/2019 | Smolke et al. |

FOREIGN PATENT DOCUMENTS

| | | | |
|---|---|---|---|
| JP | H05504252 A | 7/1993 | |
| JP | 2009225669 A | 10/2009 | |
| WO | WO-0058333 A1 | 10/2000 | |
| WO | WO-02101052 A2 | 12/2002 | |
| WO | WO-2005021763 A2 | 3/2005 | |
| WO | WO-2006015887 A2 | 2/2006 | |
| WO | WO-2008067070 A2 | 6/2008 | |
| WO | WO-2008067070 A3 | 10/2008 | |
| WO | WO-2008153094 A1 | 12/2008 | |
| WO | WO-2009122436 A2 | 10/2009 | |
| WO | WO-2011058446 A2 | 5/2011 | |
| WO | WO-2011161431 A2 | 12/2011 | |
| WO | WO-2012039438 A1 | 3/2012 | |
| WO | WO-2012135389 A2 | 10/2012 | |
| WO | WO-2013136057 A2 | 9/2013 | |
| WO | WO-2014143744 A2 | 9/2014 | |
| WO | WO-2015021561 A1 | 2/2015 | |
| WO | WO-2015066642 A1 | 5/2015 | |
| WO | WO-2015081437 A1 | 6/2015 | |
| WO | WO-2015103711 A1 | 7/2015 | |
| WO | WO-2014143744 A3 | 11/2015 | |
| WO | WO-2015164960 A1 | 11/2015 | |
| WO | WO-2015173590 A1 | 11/2015 | |
| WO | WO-2016049364 A2 | 3/2016 | |
| WO | WO-2016081371 A1 | 5/2016 | |
| WO | WO-2016149821 A1 | 9/2016 | |
| WO | WO2016/183023 | * 11/2016 | ............. C12N 15/53 |
| WO | WO-2016179296 A1 | 11/2016 | |
| WO | WO-2016207643 A1 | 12/2016 | |
| WO | WO-2017083632 A1 | 5/2017 | |
| WO | WO-2017122011 A1 | 7/2017 | |
| WO | WO-2018000089 A1 | 1/2018 | |
| WO | WO-2018005553 A1 | 1/2018 | |
| WO | WO-2018027324 A1 | 2/2018 | |
| WO | WO-2018029282 A1 | 2/2018 | |
| WO | WO-2018039749 A1 | 3/2018 | |
| WO | WO-2018136654 A1 | 7/2018 | |
| WO | WO-2019028390 | 2/2019 | |

OTHER PUBLICATIONS

Bayer et al., Synthesis of Methyl Halides from Biomass Using Engineered Microbes. J. Am. Chem. Soc. 131 (2009): 6508-6515.
Beaudoin, G. Characterization of Oxidative Enzymes Involved in the Biosynthesis of Benzylisoquinoline Alkaloids in Opium Poppy (*Papaver somniferum*). University of Calgary. Mar. 2015. 409 pages.
Bitter, Grant A., "Heterologous Gene Expression in Yeast," Methods in Enzymology, vol. 152, pp. 673-684 (1987).
Branden et al. Introduction to Protein Structure, Garland Publishing Inc., New York, (1991): p. 247.
Broun, et al. Catalytic plasticity of fatty acid modification enzymes underlying chemical diversity of plant lipids. Science. Nov. 13, 1998;282(5392):1315-7.
Bruce et al., Microbial Degradation of the Morphine Alkaloids. Purification and Characterization of Morphine Dehydrogenase from Pseudomonas putida M1 0. Biochem. J. 274.3 (1991): 875-880.
Cautha, Sarat C. Model based design of a *Saccharomyces cerevisiae* platform strain with improved tyrosine production capabilities. Masters Thesis, Toronto, Canada, (2012), 72 pages. Retrieved from the internet on Jan. 28, 2015 at: http://hdl.handle.net/1 807/33358.
Chavez-Bejar et al. Metabolic Engineering of *Escherichia coli* for L-Tyrosine Production by Expression of Genes Coding for the Chorismate Mutase Domain of the Native Chorismate Mutase-Prephenate Dehydratase and a Cyclohexadienyl Dehydrogenase from Zymomonas mobilis, Applied and Environmental Microbiology, American Society for Microbiology, US, 74.10 (Mar. 14, 2008): 3284-3290.
Choi et al., Molecular Cloning and Characterization of Coclaurine N-Methyltransferase from Cultured Cells of Coptis japonica. J. Biol. Chem. 277 (2002): 830-835.
Communication, The extended European Search Report from European patent application No. 15861129.3, dated Jul. 11, 2018, 10 pages.
Cooper et al., On the amine oxidases of Klebsiella aerogenes strain W70. FEMS Microbiol. Lett., 146.1 (1997): 85-89.
Curran et al. "Metabolic engineering of muconic acid production in *Saccharomyces cerevisiae*," Metabolic Engineering, Academic Press, US, 15 (Nov. 17, 2012): 55-66.
Devos, et al. Practical limits of function prediction. Proteins. Oct. 1, 2000;41(1):98-107.
Diaz Chavez et al., Characterization of two Methylenedioxy Bridge-Forming Cytochrome P450-Dependent Enzymes of Alkaloid Formation in the Mexican Prickly Poppy Argemone mexicana. Arch. Biochem. Biophys. 507 (2011): 186-193.
Dumas et al., 11 Beta-Hydroxylase Activity in Recombinant Yeast Mitochondria. In vivo Conversion of 11-Deoxycortisol to Hydrocortisone. Eur. J. Biochem. 238 (1996): 495-504.
European Patent Office, Search Results under Rule 164(2)(b) EPC dated May 18, 2017 in corresponding European Patent Application No. 14802992.9, 14 pages.
European search report and search opinion dated Apr. 10, 2017 for EP Application No. 14729501.8.
Examination report No. 1 for standard patent application for Australian Application No. 2015350229, dated Jul. 19, 2018, 10 pages.
Facchini et al., Differential and Tissue-Specific Expression of a Gene Family for Tyrosine/Dopa Decarboxylase in Opium Poppy. J. Biol. Chem., 269.43 (1994): 26684-26690.
Farhi et al., Harnessing Yeast Subcellular Compartments for the Production of Plant Terpenoids. Metab. Eng. 13 (2011): 474-481.
Farrow et al., Dioxygenases Catalyze O-Demethylation and O,Odemethylenation with Widespread Roles in Benzylisoquinoline Alkaloid Metabolism in Opium Poppy. J. Biol. Chem. 288 (2013): 28997-29012.
Fisinger et al., Thebaine Synthase: a New Enzyme in the Morphine Pathway in Papaver somniferum. Natural Product Communications 2.3 (2007): 249-253.
French, et al. Bacterial morphinone reductase is related to Old Yellow Enzyme. Biochem J. Dec. 15, 1995;312 ( Pt 3):671-8.
French et al., Biological Production of Semisynthetic Opiates Using Genetically Engineered Bacteria. Biotechnology (NY) 13 (1995): 674-676.
French et al., Purification and Characterization of Morphinone Reductase from Pseudomonas putida M10. Biochem. J. 301.1 (1994): 97-103.
Fukuda et al. Breeding of Brewing Yeast Producing a Large Amount of Beta-Phenylethyl Alcohol and Beta-Phenylethyl Acetate. Agricultural and Biological Chemistry, Tokyo, Japan, 54.1 (1990): 269-271.
Fukuda et al. Feedback-Insensitive Mutation of 3-Deoxy-D-Arabino-Hepturosonate-7-Phosphate Synthase Caused by a Single Nucleotide Substitution of ARO4 Structural Gene in *Saccharomyces cerevisiae*. Journal of Fermentation and Bioengineering, 74.2 (1992): 117-119.

(56) References Cited

OTHER PUBLICATIONS

Fukuda et al. Molecular Breeding of a Sake Yeast with a Mutated AR04 Gene Which Causes Both Resistance to o-Fluoro-DL-Phenylalanine and Increased Production of Beta-Phenethyl Alcohol. Journal of Fermentation and Bioengineering, 73.5 (1992): 366-369.
Geissler et al., Molecular Modeling and Site-Directed Mutagenesis Reveal the Benzylisoquinoline Binding Site of the Short-Chain Dehydrogenase/Reductase Salutaridine Reductase. Plant Physiol. 143.4 (2007): 1493-503.
Gesell et al. CVP719B1 Is Salutaridine Synthase. the C—C Phenol-coupling Enzyme of Morphine Biosynthesis in Opium Poppy. Journal of Biological Chemistry, 284.36 (Sep. 4, 2009): 24432-24442.
Gesell et al., Heterologous Expression of Two FAD-Dependent Oxidases with (S) Tetrahydroprotoberberine Oxidase Activity from Argemone mexicana and Berberis wilsoniae in Insect Cells. Planta. 233 (2011): 1185-1197.
Grothe et al., Molecular Characterization of the Salutaridinol 7-O-Acetyltransferase Involved in Morphine Biosynthesis in Opium Poppy *Papaver somniferum*. J. Biol. Chem. 276 (2001): 30717-30723.
Gustafsson et al. Codon bias and heterologous protein expression. Trends in Biotechnology, 22.7 (Jul. 2004): 346-353.
Hagel et al., Benzylisoquinoline Alkaloid Metabolism: a Century of Discovery and a Brave New World. Plant Cell Physiol. 54 (2013): 647-672.
Hagel et al., Characterization of a Flavoprotein Oxidase from Opium Poppy Catalyzing the Final Steps in Sanguinarine and Papaverine Biosynthesis. J. Biol. Chem. 287 (2012): 42972-42983.
Hagel et al., Dioxygenases Catalyze the O-Demethylation Steps of Morphine Biosynthesis in Opium Poppy. Nat. Chem. Biol. 6 (2010): 273-275.
Hartmann et al. Evolution of feedback-inhibited beta/alpha barrel isoenzymes by gene duplication and a single mutation. PNAS 100.3 (Feb. 4, 2003): 862-867.
Hawkins et al. Production of benzylisoquinoline alkaloids in *Saccharomyces cerevisiae*. Nature Chemical Biology, 4.9 (Aug. 10, 2008): 564-573.
Hawkins et al. "Supplementary Text and Figures. Production of benzylisoquinoline alkaloids in *Saccharomyces cerevisiae*," Nature Chemical Biology, Aug. 10, 2008, 15 pages.
Hawkins, K. Metabolic Engineering of *Saccharomyces cerevisiae* for the Production of Benzylisoquinoline Alkaloids. Ph.D. Thesis, California Institute of Technology, Pasadena, California, 2009, pp. 1-154.
Higashi et al., Atomic Structure of Salutaridine Reductase from the Opium Poppy (*Papaver somniferum*). J. Biol. Chem. 286 (2011): 6532-6541.
Hinnen et al, in: Yeast Genetic Engineering, Barr et al. eds, Butterworths (1989); (Hinnen et al. "Chapter 10: Heterologous Gene Expression in Yeast," Yeast Genetic Engineering, Barr et al. eds., Butterworths, pp. 193-213 (1989)).
Hiroi et al., Dopamine Formation from Tyramine by CYP2D6. Biochemical & Biophysical Research Communications, 249 (1998): 838-843.
Ikezawa et al., Molecular Cloning and Characterization of CYP719, a Methylenedioxy Bridge-Forming Enzyme that Belongs to a Novel P450 Family, from Cultured Coptis japonica Cells. J. Biol. Chem. 278 (2003): 38557-38565.
Ikezawa et al., Molecular Cloning and Characterization of Methylenedioxy Bridge-Forming Enzymes Involved in Stylopine Biosynthesis in Eschscholzia californica. FEBS J. 274 (2007): 1019-1035.
International search report and written opinion dated Sep. 15, 2015 for PCT Application No. PCT/US2014/027833 (with publication).
Jensen et al., Plant NADPH-Cytochrome P450 Oxidoreductases. Phytochemistry 71 (2010): 132-141.
Kim et al., Improvement of Reticuline Productivity from Dopamine by Using Engineered *Escherichia coli*. Biosci. Biotechnol. Biochem. 77.10 (2013): 2166-2168.
Kisselev, L. Polypeptide release factors in prokaryotes and eukaryotes: same function, different structure. Structure. Jan. 2002;10(1):8-9.
Kocharin, Kanokarn, Metabolic Engineering of *Saccharomyces cerevisiae* for Polyhydroxybutyrate Production. PhD Thesis, Apr. 2013: 168 pages.
Koopman et al. "De novo production of the flavonoid naringenin in engineered *Saccharomyces cerevisiae*," Microbial Cell Factories, Biomed Central, GB, 11.1 (Dec. 8, 2012): 155 (15 pages).
Kushnirov, Rapid and Reliable Protein Extraction from Yeast. Yeast 16 (2000): 857-860.
Kutchan et al., Molecular Genetics of Plant Alkaloid Biosynthesis. Alkaloids, 50 (1998): 257-316.
Kutchan, Tony M. Heterologous expression of alkaloid biosynthetic genes—a review. Gene, 179.1 (Nov. 7, 1996): 73-81.
Larkin et al., Increasing Morphinan Alkaloid Production by Over-Expressing Codeinone Reductase in Transgenic Papaver somniferum. Plant Biotechnol. J. 5 (2007): 26-37.
Lee et al. Bacillus licheniformis APase I gene promoter: a strong well-regulated promoter in B. Subtilis. Journal of General Microbiology, 137 (1991): 1127-1133.
Lee et al. Metabolic engineering of microorganisms: general strategies and drug production. Drug Discovery Today, Jan. 2009; 14, 1/2,(Sep. 18, 2008): 78-88.
Lenz et al., Acetyl Coenzyme A:Salutaridinol-7-O Acetyltransferase from Papaver somniferum Plant Cell Cultures. J. Biol. Chem. 270 (1995): 31091-31096.
Lenz et al., Purification and Properties of Codeinone Reductase (NADPH) from Papaver somniferum Cell Cultures and Differentiated Plants. Eur. J. Biochem. 233 (1995): 132-139.
Liscombe et al., Targeted Metabolite and Transcript Profiling for Elucidating Enzyme Function: Isolation of Novel N Methyltransferases from Three Benzylisoquinoline Alkaloid-Producing Species. Plant J. 60 (2009): 729-743.
Lister, et al. Transformations of codeine to important semisynthetic opiate derivatives by Pseudomonas putida m10. FEMS Microbiol Lett. Dec. 1, 1999;181(1):137-44.
Iraqui et al., Characterisation of *Saccharomyces cerevisiae* AR08 and AR09 genes encoding aromatic aminotransferases I and II reveals a new aminotransferase subfamily. Mol. Gen. Genet., 257.2 (1998): 238-248.
Lutke-Eversloh et al. "L-Tyrosine production by deregulated strains of *Escherichia coli*," Applied Microbiology and Biotechnology, Springer, Berlin, DE, 75.1 (Jan. 13, 2007): 103-110.
Lutke-Eversloh et al. "Perspectives of biotechnological production of L-tyrosine and its applications," Applied Microbiology and Biotechnology, Springer, Berlin, DE, 77.4 (Oct. 30, 2007): 751-762.
Luttik et al. Alleviation of feedback inhibition in *Saccharomyces cerevisiae* aromatic amino acid biosynthesis: Quantification of metabolic impact. Metabolic Engineering, 10 (2008): 141-153.
Lv et al. LC-MS-MS Simultaneous Determination of L-Dopa and Its Prodrug L-Dopa n-Pentyl Hydrochloride in Rat Plasma. Chromatographia, 72, 3/4 (2010): 239-243.
Minami et al., Microbial Production of Plant Benzylisoquinoline Alkaloids. Proc. Natl. Acad. Sci. U S A 105 (2008): 7393-7398.
Minami, H. Fermentation Production of Plant Benzylisoquinoline Alkaloids in Microbes. Bioscience, Biotechnology, and Biochemistry, 77.8 (Aug. 7, 2013): 1617-1622.
Mishra et al. "Wound Induced Tanscriptional Regulation of Benzylisoquinoline Pathway and Characterization of Wound Inducible PsWRKY Transcription Factor from Papaver somniferum," PLoS One, 8.1 (Jan. 30, 2013): 1-15.
Mizutani et al., Diversification of P450 Genes During Land Plant Evolution. Annu. Rev. Plant Biol. 61 (2010): 291-315.
Moerner et al., Illuminating single molecules in condensed matter. Science, 283.5408 (1999): 1670-1676.
Morishige et al., Molecular Characterization of the Sadenosyl-L-Methionine:3'-Hydroxy-N-Methylcoclaurine 4'-O-Methyltransferase Involved in Isoquinoline Alkaloid Biosynthesis in Coptis japonica. J. Biol. Chem. 275 (2000): 23398-23405.
Munoz et al. Metabolic engineering of *Escherichia coli* for improving L-3,4-dihydroxyphenylalanine (L-DOPA) synthesis from glucose. Journal of Industrial Microbiology and Biotechnology, 38.11 (Apr. 22, 2011): 1845-1852.

(56) References Cited

OTHER PUBLICATIONS

Nakagawa et al. A bacterial platform for fermentative production of plant alkaloids. Nature Communications, 2.326 (May 24, 2011): 8 pages.

Nakagawa et al., Bench-Top Fermentative Production of Plant Benzylisoquinoline Alkaloids Using a Bacterial Platform. Bioeng. Bugs, 3 (2012): 49-53.

Nakagawa, et al. Bioengineering of Isoquinoline alkaloid production in microbial systems. Adv. Botanical Res., 2013, vol. 68, Chapter 7: 183-203. (Year: 2013).

Nakagawa, et al. (R,S)-Tetrahydropapaveroline production by stepwise fermentation using engineered *Escherichia coli*. Nature Scientific Reports, 2014, vol. 4: 6695, pp. 1-8. (Year: 2014).

Ng et al. "Production of 2,3-butanediol in *Saccharomyces cerevisiae* by in silica aided metabolic engineering," Microbial Cell Factories, Biomed Central, GB, 11.1 (May 28, 2012): 68 (14 pages).

Notice of allowance dated Oct. 14, 2016 for U.S. Appl. No. 14/211,611.

Notice of allowance dated Nov. 7, 2014 for U.S. Appl. No. 11/875,814.

Notice of allowance dated Nov. 18, 2016 for U.S. Appl. No. 14/211,611.

Office action dated Feb. 18, 2009 for U.S. Appl. No. 11/875,814.
Office action dated May 23, 2014 for U.S. Appl. No. 11/875,814.
Office action dated Jul. 25, 2016 for U.S. Appl. No. 14/211,611.
Office action dated Dec. 3, 2013 for U.S. Appl. No. 11/875,814.
Office action dated Dec. 10, 2015 for U.S. Appl. No. 14/211,611.
Office action dated Dec. 29, 2009 for U.S. Appl. No. 11/875,814.

Olson et al. Production of tyrosine from sucrose or glucose achieved by rapid genetic changes to phenylalanine-producing *Escherichia coli* strains. Applied Microbiology and Biotechnology, 74.5 (Jan. 11, 2007): 1031-1040.

Onoyovwe et al., Morphine Biosynthesis in Opium Poppy Involves Two Cell Types: Sieve Elements and Laticifers. Plant Cell, 25.10 (2013): 4110-4122.

Ounaroon et al., (R,S)-Reticuline 7-O-Methyltransferase and (R,S)-Norcoclaurine 6-O-Methyltransferase of Papaver somniferum-cDNA Cloning and Characterization of Methyl Transfer Enzymes of Alkaloid Biosynthesis in Opium Poppy. Plant J. 36 (2003): 808-819.

PCT/US2014/063738 International Preliminary Report on Patentability dated May 10, 2016, 18 pages.

PCT/US2014/063738 International Search Report dated Apr. 9, 2015, 8 pages.

PCT/US2014/063738 Written Opinion dated Apr. 9, 2015, 10 pages.

Rueffer et al. (S)-Norlaudanosoline Synthase—The 1 st Enzyme in the Benzylisoquinoline Biosynthetic-Pathway. FEBS Letters, 129.1 (Jun. 1981): 5-9.

Runguphan, et al. Redesign of a dioxygenase in morphine biosynthesis. Chem Biol. Jun. 22, 2012;19(6):674-8.

Ruohonen et al. Modifications to the ADH1 promoter of *Saccharomyces cerevisiae* for efficient production of heterologous proteins. Journal of Biotechnology, 39 (1995): 193-203.

Samanani et al., Molecular cloning and characterization of norcoclaurine synthase, an enzyme catalyzing the first committed step in benzylisoquinoline alkaloid biosynthesis. Plant J., 40.2 (2004): 302-313.

Sandig et al., Regulation of Endoplasmic Reticulum Biogenesis in Response to Cytochrome P450 Overproduction. Drug Metab. Rev. 31 (1999): 393-410.

Sato et al., Purification and Characterization of S-adenosyl-L-methionine: norcoclaurine 6-O-methyltransferase from Cultured Coptis japonica Cells. Eur. J. Biochem. 225 (1994): 125-131.

Schmidheini, et al., A Single Point Mutation Results in a Constitutively Activated and Feedback-Resistant Chorismate Mutase of *Saccharornyces-cerevisiae*. J Bacteriol., 171(3):1245-1253, 1989.

Schmidt et al. Poppy alkaloid profiling by electrospray tandem mass spectrometry and electrospray FT-ICR mass spectrometry after [ring-1 3C6]-tyramine feeding. Phytochemistry, 68.2 (2007): 189-202.

Seffernick, et al. Melamine deaminase and atrazine chlorohydrolase: 98 percent identical but functionally different. J Bacteriol. Apr. 2001;183(8):2405-10.

Sharafi, et al. Metabolic engineering of morphinan alkaloids by over-expression of codeinone reductase in transgenic hairy roots of *Papaver bracteatum*, the Iranian poppy. Biotechnol Lett. Mar. 2013;35(3):445-53.

Siddiqui et al., Advancing Secondary Metabolite Biosynthesis in Yeast with Synthetic Biology Tools. FEMS Yeast Res. 12 (2012): 144-170.

Single Molecule Detection and Manipulation Workshop, Apr. 17-18, 2000, 28 pages. Retrieved from http://www.nigms.nih.gov/news/reports/single_molecules.html.

International Search Report for PCT/US07/81974, dated Jul. 8, 2008, 3 pages.

Stewart et al., A Chemist's Perspective on the Use of Genetically Engineered Microbes as Reagents for Organic Synthesis. Biotechnology and Genetic Engineering Reviews, 14 (1997): 67-143.

Takemura et al., Molecular Cloning and Characterization of a Cytochrome P450 in Sanguinarine Biosynthesis from Eschscholzia californica Cells. Phytochemistry, 91 (2013): 100-108.

Trenchard et al. "De novo production of the key branch point benzylisoquinoline alkaloid reticuline in yeast," Metab. Eng., 31 (Jul. 10, 2015): 74-83.

Unterlinner et al., Molecular Cloning and Functional Expression of Codeinone Reductase: the Penultimate Enzyme in Morphine Biosynthesis in the Opium Poppy *Papaver somniferum*. Plant J. 18 (1999): 465-475.

U.S. Appl. No. 15/078,874 Office Action dated Feb. 16, 2018.
U.S. Appl. No. 15/139,263 Office Action dated Feb. 16, 2018.
U.S. Appl. No. 15/360,763 Notice of Allowance dated May 11, 2018.
U.S. Appl. No. 15/360,763 Office Action dated Apr. 10, 2018.
U.S. Appl. No. 15/360,763 Office Action dated Dec. 20, 2017.
U.S. Appl. No. 15/567,354 Office Action dated Jul. 19, 2018.
U.S. Appl. No. 15/567,358 Office Action dated Sep. 17, 2018.

Vuralhan et al., Identification and characterization of phenylpyruvate decarboxylase genes in *Saccharomyces cerevisiae*. Appl. Environ. Microbial., 69.8 (2003): 4534-4541.

Vuralhan, Z. "Engineering of aromatic amino acid metabolism in *Saccharomyces cerevisiae*," Ph. D. Thesis. (Apr. 11, 2006): 1-110.

Walker, et al. Mechanistic studies of morphine dehydrogenase and stabilization against covalent inactivation. Biochem J. Feb. 1, 2000;345 Pt 3:687-92.

Whisstock, et al. Prediction of protein function from protein sequence and structure. Q Rev Biophys. Aug. 2003;36(3):307-40.

Wijekoon et al., Systematic Knockdown of Morphine Pathway Enzymes in Opium Poppy Using Virus-Induced Gene Silencing. Plant J. 69 (2012): 1052-1063.

Willey, et al. Nucleotide sequence and over-expression of morphine dehydrogenase, a plasmid-encoded gene from Pseudomonas putida M10. Biochem J. Mar. 1, 1993;290 ( Pt 2):539-44.

Winzer, et al. A Papaver somniferum 10-gene cluster for synthesis of the anticancer alkaloid noscapine. Science. Jun. 29, 2012;336(6089):1704-8.

Witkowski, et al. Conversion of a beta-ketoacyl synthase to a malonyl decarboxylase by replacement of the active-site cysteine with glutamine. Biochemistry. Sep. 7, 1999;38(36):11643-50.

Zenk et al., Benzylisoquinoline Biosynthesis by Cultivated Plant Cells and Isolated Enzymes. Journal of Natural Products, 48.5 (1985): 725-738.

Zhang et al., 14-Hydroxylation of Opiates: Catalytic Direct Autoxidation of Codeinone to 14-Hydroxycodei none. J. Am. Chem. Soc. 127 (2005): 7286-7287.

Ziegler et al., Removal of Substrate Inhibition and Increase in Maximal Velocity in the Short Chain Dehydrogenase/Reductase Salutaridine Reductase Involved in Morphine Biosynthesis. J. Biol. Chem. 284 (2009): 26758-26767.

Zimmer et al., Protein Quality—a Determinant of the Intracellular Fate of Membrane-Bound Cytochromes P450 in Yeast. DNA Cell Biol. 16 (1997): 501-514.

Communication pursuant to Article 94(3) EPC issued for European patent application No. 14802992.9, dated Feb. 19, 2019.

(56) References Cited

OTHER PUBLICATIONS

Doray, et al. N-terminal deletions and His-tag fusions dramatically affect expression of cytochrome p450 2C2 in bacteria. Arch Biochem Biophys. Sep. 1, 2001;393(1):143-53.

EP16793332.4 The Partial Supplementary European Search Report dated Feb. 28, 2019.

Farrow, et al. Stereochemical inversion of (S)-reticuline by a cytochrome P450 fusion in opium poppy. Nat Chem Biol. Sep. 2015;11(9):728-32. doi: 10.1038/nchembio.1879. Epub Jul. 1, 2015.

Girvan, et al. Applications of microbial cytochrome P450 enzymes in biotechnology and synthetic biology. Curr Opin Chem Biol. Apr. 2016;31:136-45. doi: 10.1016/j.cbpa.2016.02.018. Epub Mar. 22, 2016.

Hirata, et al. 1,2-Dehydroreticuline synthase, the branch point enzyme opening the morphinan biosynthetic pathway. Phytochemistry. Apr. 2004;65(8):1039-46.

International search report and written opinion dated Aug. 4, 2016 for PCT Application No. PCT/US2016/030808.

Kenaan, et al. Uncovering the role of hydrophobic residues in cytochrome P450-cytochrome P450 reductase interactions. Biochemistry. May 17, 2011;50(19):3957-67. doi: 10.1021/bi1020748. Epub Apr. 22, 2011.

PCT/US2018/045222 International Search Report and Written Opinion dated Jan. 3, 2019.

U.S. Appl. No. 16/165,940 Office Action dated Dec. 17, 2018.
U.S. Appl. No. 15/517,761 Office Action dated Feb. 26, 2019.
U.S. Appl. No. 16/191,247 Office Action dated Jan. 15, 2019.
U.S. Appl. No. 15/567,354 Office Action (Restriction Requirement) dated Feb. 4, 2019.

Zelasko, et al. Optimizations to achieve high-level expression of cytochrome P450 proteins using *Escherichia coli* expression systems. Protein Expr Purif. Nov. 2013;92(1):77-87. doi: 10.1016/j.pep.2013.07.017. Epub Aug. 20, 2013.

Communication, The Extended European Search Report for European patent application No. 16793332.4, dated May 29, 2019, 12 pages.

De-Eknamkul, et al. Purification and properties of 1,2-dehydroreticuline reductase from Papaver somniferum seedlings. Phytochemistry 31, 813-821, 1992.

U.S. Appl. No. 15/031,618 Office Action dated May 16, 2019.
U.S. Appl. No. 15/567,354 Office Action dated May 1, 2019.
U.S. Appl. No. 16/165,940 Office Action dated May 15, 2019.

* cited by examiner

SEQ ID No. 153

MELQYISYFQPTSSVVALLLALVSILSSVVVLRKTFLNNYSSSPASSTKTAVLSHQRQQSCALPISGLLH
IFMNKNGLIHVTLGNMADKYGPIFSFPTGSHRTLVVSSWEMVKECFTGNNDTAFSNRPIPLAFKTIFYAC
GGIDSYGLSSVPYGKYWRELRKVCVHNLLSNQQLLKFRHLIISQVDTSFNKLYELCKNSEDNQGNYPTTT
TAAGMVRIDDWLAELSFNVIGRIVCGFQSGPKTGAPSRVEQFKEAINEASYFMSTSPVSDNVPMLGWIDQ
LTGLTRNMKHCGKKLDLVVESIINDHRQKRRFSRTKGGDEKDDEQDDFIDICLSIMEQPQLPGNNNPSQI
PIKSIVLDMIGGGTDTTKLTTIWTLSLLLNNPHVLDKAKQEVDAHFRTKRRSTNDAAAAVVDFDDIRNLV
YIQAIIKESMRLYPASPVVERLSGEDCVVGGFHVPAGTRLWANVWKMQRDPKVWDDPLVFRPDRFLSDEQ
KMVDVRGQNYELLPFGAGRRVCPGVSFSLDLMQLVLTRLILEFEMKSPSGKVDMTATPGLMSYKVIPLDI
LLTHRRIKPCVQSAASERDMESSGVPVITLGSSGKVMPVLGMGTFEKVGKGSERERLAILKAIEVGYRYFD
TAAAYETEEVLGEAIAEALQLGLVKSRDELFISSMLWCTDAHADRVLLALQNSLRNLKLEYVDLYMLPFP
ASLKPGKITMDIPEEDICRMDYRSVWAAMEECQNLGFTKSIGVSNFSCKKLQELMATANIPPAVNQVEMS
PAFQQKKLREYCNANNILVSAISVLGSNGTPWGSNAVLGSEVLKKIAMAKGKSVAQVSMRWVYEQGASLV
VKSFSEERLRENLNIFDWELTKEDHEKIGEIPQCRILSAYFLVSPNGPFKSQEELWDDEA

FIG. 4

Split Enzymes originating from SEQ ID No. 16

DRS enzyme (SEQ ID No. 17):

MELQYFSYFQPTSSVVALLLALVSILFSVVVLRKTFSNNYSSPASSTETAVLCHQRQQSCALPISGLLH
VFMNKNGLIHVTLGNMADKYGPIFSFPTGSHRTLVSSWEMVKECFTGNNDTAFSNRPIPLAFQTI
FYACGGIDSYGLSSVPYGKYWRELRKVCVHNLLSNQQLLKFRHLIISQVDTSFNKLYELCKNSEDNQ
GMVRMDDWLAQLSFNVIGRIVCGFQSDPKTGAPSRVEQFKEVINEASYFMSTSPVSDNVPMLG
WIDQLTGLTRNMKHCGKKLDLVVESIIKDHRQKRRFSRTKGGDEKDDEQDDFIDICLSIMEQPQLP
GNNSPPQIPIKSIVLDMIGGGTDTTKLITIWTLSLLLNNPHVLDKAKQEVDAHFRKKRRSTDDAAA
AVVDFDDIRNLVYIQAIIKESMRLYPASPVVERLSGEDCVVGGFHVPAGTRLWANVWKMQRDPKV
WDDPLVFRPERFLSDEQKMVDVRGQNYELLPFGAGRRICPGVSFSLDLMQLVLTRLILEFEMKSPS
GKVDMTATPGLMSYKVVPLDILLTHRRIKSCVQLASSERD *

DRR enzyme (SEQ ID No. 18):

MESSGVPVITLSSGKVMPVLGMGTFEKVGKGSERERLAILKAIEVGYRYFDTAAAYETEEVLGEAIAE
ALQLGLIESRDELFISSMLWCTDAHPDRVLLALQNSLRNLKLEYLDLYMLPFPASLKPGKITMDIPEE
DICRMDYRSVWSAMEECQNLGFTKSIGVSNFSCKKLQELMATANIPPAVNQVEMSPAFQQKKLRE
YCNANNILVSAVSILGSNGTPWGSNAVLGSEVLKQIAMAKGKSVAQVSMRWVYEQGASLVVKSFS
EERLRENLNIFDWELTKEDNEKIGEIPQCRILTAYFLVSPNGPFKSQEELWDDKA*

FIG. 5

3-O-demethylase (ODM):

| | Substrate | Product |
|---|---|---|
| | Codeine | Morphine |
| | Oxycodone | Oxymorphone |
| | Thebaine | Oripavine |
| | Hydrocodone | Hydromorphone |
| | Dihydrocodeine | Dihydromorphine |
| | 14-hydroxycodeine | 14-hydroxymorphine |
| | Codeinone | Morphinone |
| | 14-hydroxycodeinone | 14-hydroxymorphinone |

Alignment between PbDRS-DRR, PrDRS, and PrDRR

ENGINEERED BENZYLISOQUINOLINE ALKALOID EPIMERASES AND METHODS OF PRODUCING BENZYLISOQUINOLINE ALKALOIDS

CROSS-REFERENCE

This application is a continuation of International Patent Application No. PCT/US2018/045222, filed Aug. 3, 2018, which claims the benefit of U.S. Provisional Application No. 62/541,038, filed Aug. 3, 2017, each of which application is incorporated herein by reference.

SEQUENCE LISTING

The instant application contains a Sequence Listing which has been submitted electronically in ASCII format and is hereby incorporated by reference in its entirety. Said ASCII copy, created on Sep. 20, 2018, is named 47840-707_601_SL.txt and is 620,868 bytes in size.

SUMMARY OF THE INVENTION

The present disclosure provides methods for the production of diverse benzylisoquinoline alkaloids (BIAs) in engineered host cells comprising engineered epimerases. Additionally, the present disclosure provides methods for the production of an engineered epimerase. Engineered epimerases may comprise engineered fused epimerases and engineered split epimerases. Engineered fused epimerases may have one or more modifications to an oxidase portion of the engineered fused epimerase. These one or more modifications may increase activity of the epimerase. In some embodiments, an engineered fused enzyme may have an oxidase enzyme portion and a reductase enzyme portion that originated from different parent enzymes, respectively.

Engineered epimerases may also comprise engineered split epimerases. In some embodiments, a split epimerase may comprise an epimerase system having two separate components. In some embodiments, a split epimerase may comprise a first protein comprising an oxidase component and a second, separate protein comprising a reductase component. In some cases, the oxidase component and the reductase component of a split epimerase are encoded by separate mRNAs. In some cases, the oxidase component and the reductase component of a split epimerase are encoded by a same mRNA and are translated from separate translation initiation sites. In some cases, the oxidase component of a split epimerase is encoded by a first mRNA, and the reductase component of the same split epimerase is encoded by a second, separate mRNA. In some cases, the oxidase component of a split epimerase comprises a first molecule and the reductase component of the same split epimerase comprises a second molecule. In some cases, a split epimerase comprises a first protein encoded by a first transcription unit in a first genomic location and a second protein encoded by a second transcription unit in a second genomic location.

In some embodiments, an engineered split epimerase may comprise two separate enzymes encoding an oxidase and a reductase, in engineered host cells. In some embodiments, an engineered split epimerase may further comprise an engineered oxidase portion having one or more modifications to increase activity of the epimerase. In some embodiments, an engineered split epimerase may have an oxidase enzyme and reductase enzyme split from a parent fused enzyme. In some embodiments, an engineered split epimerase may have an oxidase enzyme split from a first parent fused enzyme and a reductase enzyme split from a second parent fused enzyme that is different than the first parent fused enzyme. In some embodiments, an engineered split epimerase may have an oxidase enzyme that originates from a portion of a first parent enzyme and a reductase enzyme that originates from a portion of a second parent enzyme.

In some embodiments, the disclosure provides methods for increasing production of an alkaloid product through the epimerization of a (S)-1-benzylisoquinoline alkaloid to a (R)-1-benyzlisoquinoline alkaloid via an engineered split epimerase in an engineered host cell in comparison to the epimerization of a (S)-1-benzylisoquinoline alkaloid to a (R)-1-benzylisoquinoline alkaloid via a fused epimerase in similar conditions. In some methods, the methods comprise contacting said (S)-1-benzylisoquinoline alkaloid with said engineered split epimerase in said engineered host cell, thereby increasing production of an alkaloid product, wherein contacting said (S)-1-benzylisoquinoline alkaloid with said engineered split epimerase converts said (S)-1-benzylisoquinoline alkaloid to said (R)-1-benzylisoquinoline alkaloid within said engineered host cell.

In some embodiments, the disclosure provides methods for producing an alkaloid product through the epimerization of a (S)-1-benzylisoquinoline alkaloid to a (R)-1-benyzlisoquinoline alkaloid via an engineered split epimerase in an engineered host cell. In some methods, the methods comprise contacting said (S)-1-benzylisoquinoline alkaloid with said engineered split epimerase in said engineered host cell, thereby increasing production of an alkaloid product, wherein contacting said (S)-1-benzylisoquinoline alkaloid with said engineered split epimerase converts said (S)-1-benzylisoquinoline alkaloid to said (R)-1-benzylisoquinoline alkaloid within said engineered host cell, wherein said engineered split epimerase comprises an oxidase component and a reductase component, wherein said oxidase component comprises a sequence that is at least 80% homologous to SEQ ID NO. 17, and wherein said reductase component comprises a sequence that is at least 80% homologous to SEQ ID NO. 18.

In some embodiments, the disclosure provides engineered host cells which comprise an engineered split epimerase, wherein said engineered split epimerase increases conversion of a (S)-1-benzylisoquinoline alkaloid to a (R)-1-benzylisoquinoline alkaloid relative to conversion of a (S)-1-benzylisoquinoline alkaloid to a (R)-1-benzylisoquinoline alkaloid via a fused epimerase under similar conditions.

In some embodiments, the disclosure provides methods for increasing production of diverse alkaloid products through the epimerization of a (S)-1-benzylisoquinoline alkaloid to a (R)-1-benyzlisoquinoline alkaloid via engineered epimerases in an engineered host cell. In further embodiments, the present disclosure provides methods for increasing production of diverse alkaloid products through the epimerization of (S)-reticuline to (R)-reticuline via an engineered epimerase comprising two separate enzymes encoding an oxidase and a reductase compared to the production of diverse alkaloid products through the epimerization of (S)-reticuline to (R)-reticuline via a wild-type epimerase.

An additional aspect of the invention provides a method of increasing the efficiency of epimerizing a (S)-1-benzylisoquinoline alkaloid to a (R)-1-benzylisoquinoline alkaloid relative to a wild-type epimerase by utilizing one or more engineered epimerases. The method comprises contacting the (S)-1-benzylisoquinoline alkaloid with one or more engineered epimerases. In some embodiments, an engineered split epimerase comprises two separate enzymes encoding an oxidase and a reductase. Contacting the (S)-1-benzylisoquinoline alkaloid with the oxidase enzyme of the engineered split epimerase and, separately, the reductase enzyme of the engineered split epimerase, converts more of a (S)-1-benzylisoquinoline alkaloid to a (R)-1-benzylisoquinoline alkaloid relative to a wild-type epimerase.

While engineered split epimerases may be composed of a separate oxidase enzyme and reductase enzyme that originate from a parent or wild-type epimerase, engineered epimerases may also comprise a separate oxidase enzyme and reductase enzyme that originate from separate parent or wild-type epimerases. Examples of parent epimerases having an oxidase and reductase component comprise amino acid sequences selected from the group consisting of: SEQ ID NOs: 1, 2, 3, 4, 5, 6, 7, 8, 9, 10, 11, 12, 13, 14, and 15, as listed in Table 1.

A further aspect of the invention provides a process for converting a (S)-1-benzylisoquinoline alkaloid to a (R)-1-benzylisoquinoline alkaloid comprising contacting the (S)-1-benzylisoquinoline alkaloid with an engineered oxidase, comprising at least one modification, and a reductase in an amount sufficient to convert the (S)-1-benzylisoquinoline alkaloid to (R)-1-benzylisoquinoline alkaloid. The engineered oxidase may have one or more modifications that improve conversion of a (S)-1-benzylisoquinoline alkaloid to a (R)-1-benzylisoquinoline alkaloid. In some embodiments, the engineered oxidase may be within an engineered split epimerase, where the engineered oxidase enzyme and the reductase enzyme are separate. In some embodiments, the engineered oxidase may be within an engineered fused epimerase, where the engineered oxidase enzyme and the reductase enzyme are fused.

In another aspect of the invention, a method of epimerizing a stereocenter of a 1-benzylisoquinoline alkaloid is provided. The method comprises contacting the 1-benzylisoquinoline alkaloid with at least one engineered epimerase. Contacting the 1-benzylisoquinoline alkaloid with an engineered split epimerase inverts the stereochemistry of the stereocenter of the 1-benzylisoquinoline alkaloid to the opposite stereochemistry of the stereocenter of the 1-benzylisoquinoline alkaloid more efficiently than using a wild-type epimerase.

In some examples, an engineered non-plant cell comprises a plurality of coding sequences each encoding an enzyme that is selected from the group of enzymes listed in Table 3. In some examples, the heterologous coding sequences may be operably connected. Heterologous coding sequences that are operably connected may be within the same pathway of producing a particular benzylisoquinoline alkaloid product via an engineered epimerase activity, comprising engineered oxidase and reductase enzymes.

In an additional aspect of the invention, an engineered non-plant cell that produces an increased amount of a bisbenzylisoquinoline alkaloid product using an engineered split epimerase in contrast to the use of a wild-type epimerase is provided. In a further aspect of the invention, an engineered non-plant cell that produces an increased amount of bisbenzylisoquinoline product using an engineered fused epimerase in contrast to the use of a wild-type epimerase is provided. The bisbenzylisoquinoline alkaloid is produced using a coupling enzyme that is present within the engineered non-plant cell. Additionally, the engineered non-plant cell comprises at least two heterologous coding sequences encoding an engineered split epimerase, having a separate oxidase enzyme and a separate reductase enzyme, used in the production of at least one benzylisoquinoline alkaloid monomer within the engineered non-plant cell. Further, the at least one coupling enzyme dimerizes two benzylisoquinoline alkaloid monomers within the engineered non-plant cell, thereby forming the bisbenzylisoquinoline alkaloid.

In an additional aspect of the invention, an engineered non-plant cell that produces an increased amount of a pro-morphinan or morphinan alkaloid product using an engineered split epimerase in contrast to the use of a wild-type epimerase is provided. In a further aspect of the invention, an engineered non-plant cell that produces an increased amount of a pro-morphinan or morphinan alkaloid product using an engineered fused epimerase in contrast to the use of a wild-type epimerase is provided. The engineered non-plant cell comprises at least two heterologous coding sequences encoding an engineered split epimerase, having a separate oxidase enzyme and a separate reductase enzyme, used in the production of at least one morphinan alkaloid within the engineered non-plant cell.

In an additional aspect of the invention, an engineered non-plant cell that produces an increased amount of a nal-opioid or nor-opioid product using an engineered split epimerase in contrast to the use of a wild-type epimerase is provided. In a further aspect of the invention, an engineered non-plant cell that produces an increased amount of a nal-opioid or nor-opioid product using an engineered fused epimerase in contrast to the use of a wild-type epimerase is provided. The engineered non-plant cell comprises at least two heterologous coding sequences encoding an engineered split epimerase, having a separate oxidase enzyme and a separate reductase enzyme, used in the production of at least one nal-opioid or nor-opioid within the engineered non-plant cell.

In some embodiments, the disclosure provides methods for increasing production of diverse alkaloid products through the conversion of a promorphinan alkaloid to a morphinan alkaloid via thebaine synthases in an engineered host cell. In further embodiments, the present disclosure provides methods for increasing production of diverse alkaloid products through the conversion of salutaridinol-7-O-acetate to thebaine via a thebaine synthase. Examples of parent thebaine synthases comprise amino acid sequences selected from the group consisting of: SEQ ID NOs: 30, 31, 32, 33, and 34, as listed in Table 2.

In some embodiments, the disclosure provides methods for increasing production of diverse alkaloid products through the conversion of a promorphinan alkaloid to a morphinan alkaloid via engineered thebaine synthases in an engineered host cell. In further embodiments, the present disclosure provides methods for increasing production of diverse alkaloid products through the conversion of salutaridinol-7-O-acetate to thebaine via an engineered thebaine synthase.

In some embodiments, the engineered thebaine synthase is a fusion enzyme. In further embodiments, the thebaine synthase is fused to an acetyl transferase enzyme. In further embodiments, the thebaine synthase is encoded within an acetyl transferase enzyme. In other embodiments, the thebaine synthase is fused to a reductase enzyme.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the invention will be obtained by reference to the following detailed description that sets forth illustrative embodiments, in which the principles of the invention are utilized, and the accompanying drawings of which:

FIG. 4 illustrates an amino acid sequence of a parent DRS-DRR fusion enzyme, in accordance with embodiments of the invention.

FIG. 5 illustrates amino acid sequences of a DRS enzyme and a DRR enzyme, respectively, that are derived from a parent fusion enzyme illustrated in FIG. 4, in accordance with embodiments of the invention.

FIG. 6 illustrates an enzyme having opioid 3-O-demethylase activity, in accordance with embodiments of the invention.

FIG. 7 illustrates an enzyme having opioid N-demethylase activity, in accordance with embodiments of the invention.

DETAILED DESCRIPTION OF THE INVENTION

Figure 1:
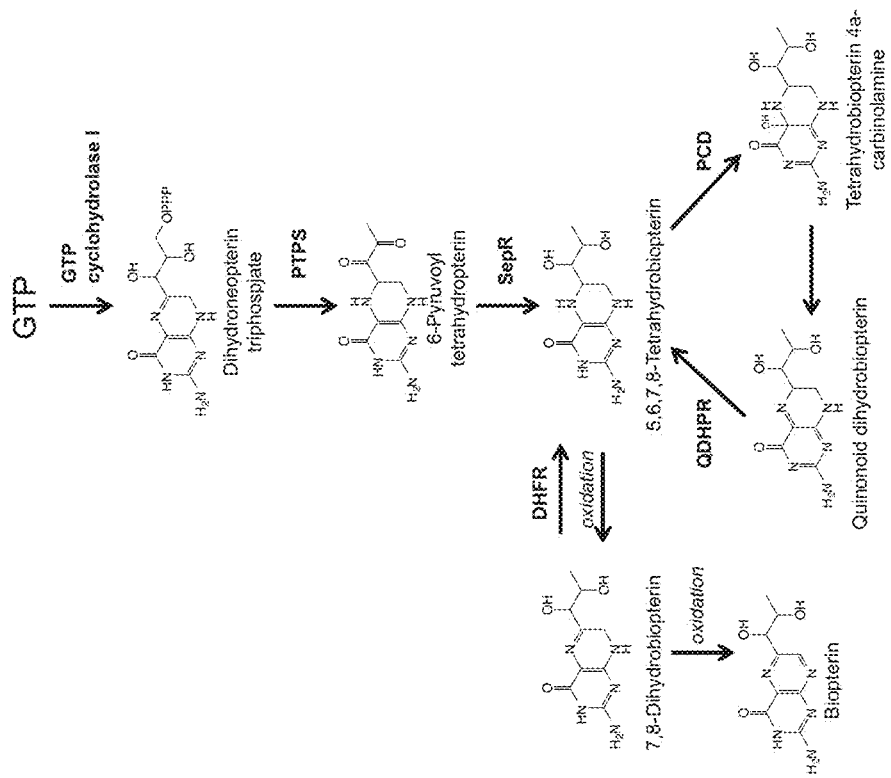
FIG. 1 illustrates examples of synthesis, recycling, and salvage pathways of tetrahydrobiopterin, in accordance with embodiments of the invention.

The disclosure provides methods for increased production of diverse alkaloid products, in comparison to the use of a fused DRS-DRR epimerase, through the independent expression of dehydroreticuline synthase (DRS) and dehydroreticuline reductase (DRR) enzymes and the use of DRS and DRR enzymes in epimerization of a (S)-1-benzylisoquinoline alkaloid to a (R)-1-benyzlisoquinoline alkaloid. The present disclosure also provides methods for the production of diverse benzylisoquinoline alkaloids (BIAs) in engineered host cells using engineered epimerases. Additionally, the present disclosure provides methods for the production of a set of engineered epimerases in engineered host cells. In some cases, the DRS and DRR enzymes may be derived from a parent epimerase. In some cases, the DRS and DRR enzymes may each be derived from a separate parent epimerase. In some cases, the DRS and DRR enzymes may be derived from one or more parent epimerases. As discussed herein, the independent expression of DRS and DRR, when compared to the expression of fused DRS-DRR, substantially improves the conversion of a (S)-1-benzylisoquinoline alkaloid to a (R)-1-benyzlisoquinoline alkaloid, including (S)-reticuline to (R)-reticuline. In particular cases, the disclosure provides methods for producing bisbenzylisoquinoline, promorphinan, morphinan, nal-opioid, and nor-opioid alkaloid products through the increased conversion of a (S)-1-benzylisoquinoline alkaloid to a (R)-1-benzylisoquinoline alkaloid in an engineered host cell. In further particular cases, the disclosure provides methods for producing promorphinan, morphinan, nal-opioid, and nor-opioid alkaloid products through the increased conversion of (S)-reticuline to (R)-reticuline in an engineered host cell. In further particular cases, the present disclosure provides methods for producing diverse alkaloid products through the increased conversion of a (S)-1-benzylisoquinoline alkaloid to a (R)-1-benyzlisoquinoline alkaloid.

The conversion of (S)-reticuline to (R)-reticuline is an important step in the production of morphinan alkaloids in opium poppies. In recent years, several different academic groups independently identified fused DRS-DRR variants that carry out this step (Winzer et al. 2015, Farrow et al. 2015, Galanie et al. 2015). A notable feature of this enzyme is that in the morphinan alkaloid-producing plants, it is found as a translational fusion between two enzymes, a cytochrome P450 and an aldo-keto reductase. In closely related plants that do not produce these compounds, these enzymes are not fused and are thus expressed separately. It is thought that the fusion of the two enzymes allows for improved substrate channeling, since the product of the first enzyme, which converts (S)-reticuline to dehydroreticuline, is the direct substrate of the second enzyme, which converts dehydroreticuline to (R)-reticuline (Winzer et. al. 2015).

This application describes protein engineering improvements to DRS-DRR variants that resulted in substantial increases in activity in comparison to a parental molecule. Experimental results show that the separation and independent expression of two enzymes, a cytochrome P450 called dehydroreticuline synthase (DRS), and an aldo-keto reductase called dehydroreticuline reductase (DRR), derived from an evolutionarily fused parent enzyme, substantially improved conversion of (S)- to (R)-reticuline in a heterologous yeast host cell. Improvements to DRS via mutagenesis and screening also improved activity of the enzyme.

The examples discussed herein show that the separation and expression of independent DRS and DRR enzymes, derived from one or more parental epimerases, in a strain harboring a benzylisoquinoline alkaloid (BIA) pathway, resulted in a substantial increase in salutaridine production, when saluturidine synthase (SalSyn) activity was not limiting relative to the amount of (R)-reticuline produced. The strain expressing DRS and DRR separately further showed a quantitative increase in all BIA pathway intermediates up to salutaridine. Upon chiral separation of reticuline from yeast, cells that expressed DRS and DRR separately produced predominantly (R)-reticuline, in comparison to a parental DRS-DRR fusion enzyme, which produced equivalent amounts of (S)- and (R)-reticuline. To investigate which of the independent DRS and DRR activities was limiting, a series of vectors with varying promoter strengths was constructed. Differential expression of DRS and DRR showed that intracellular DRS activity was limiting relative to DRR. To better understand the function of DRS in yeast, and to assign function to beneficial residues identified by protein engineering improvements, a structural homology model was built based on the existing structure of human steroidogenic cytochrome P450 CYP17A1. To improve intracellular DRS activity, the ORF of DRS was randomly mutagenized and nearly 5,000 independent mutant variants were screened for salutaridine production. From these variants, a combinatorial variant containing 6 different mutations was identified and selected for introduction and expression in BIA production strains.

In particular cases, the disclosure provides methods for producing promorphinan, morphinan, nal-opioid and nor-opioid alkaloid products through the increased conversion of a promorphinan alkaloid to a morphinan alkaloid in an engineered host cell. In further particular cases, the disclosure provides methods for producing morphinan, nal-opioid and nor-opioid alkaloid products through the increased conversion of a promorphinan alkaloid to a morphinan alkaloid in an engineered host cell. In further particular cases, the present disclosure provides methods for producing diverse alkaloid products through the increased conversion of a promorphinan alkaloid to a morphinan alkaloid.

Benzylisoquinoline Alkaloids (BIAs) of Interest

Host cells which produce BIAs of interest are provided. In some examples, engineered strains of host cells such as the engineered strains of the invention provide a platform for producing benzylisoquinoline alkaloids of interest and modifications thereof across several structural classes including, but not limited to, precursor BIAs, benzylisoquinolines, promorphinans, morphinans, bisbenzylisoquinolines, nal-opioids, nor-opioids, and others. Each of these classes is meant to include biosynthetic precursors, intermediates, and metabolites thereof, of any convenient member of an engineered host cell biosynthetic pathway that may lead to a member of the class. Non-limiting examples of compounds are given below for each of these structural classes. In some cases, the structure of a given example may or may not be characterized itself as a benzylisoquinoline alkaloid. The present chemical entities are meant to include all possible isomers, including single enantiomers, racemic mixtures, optically pure forms, mixtures of diastereomers, and intermediate mixtures.

Benzylisoquinoline alkaloid precursors may include, but are not limited to, norcoclaurine (NC) and norlaudanosoline (NL), as well as NC and NL precursors, such as tyrosine, tyramine, 4-hydroxyphenylacetaldehyde (4-HPA), 4-hydroxyphenylpyruvic acid (4-HPPA), L-3,4-dihydroxyphenylalanine (L-DOPA), 3,4-dihydroxyphenylacetaldehyde (3,4-DHPA), and dopamine. In some embodiments, the one or more BIA precursors are 3,4-dihydroxyphenylacetaldehyde (3,4-DHPA) and dopamine. In certain instances, the one or more BIA precursors are 4-hydroxyphenylacetaldehyde (4-HPA) and dopamine. In particular, NL and NC may be synthesized, respectively, from precursor molecules via a Pictet-Spengler condensation reaction, where the reaction may occur spontaneously or may by catalyzed by any convenient enzymes.

Benzylisoquinolines may include, but are not limited to, norcoclaurine, norlaudanosoline, coclaurine, 3'-hydroxycoclaurine, 4'-O-methylnorlaudanosoline, 4'-O-methyl-laudanosoline, N-methylnorcoclaurine, laudanosoline, N-methylcoclaurine, 3'-hydroxy-N-methylcoclaurine, reticuline, norreticuline, papaverine, laudanine, laudanosine, tetrahydropapaverine, 1,2-dihydropapaverine, and orientaline.

Promorphinans may include, but are not limited to, salutaridine, salutaridinol, and salutaridinol-7-O-acetate.

Morphinans may include, but are not limited to, thebaine, codeinone, codeine, morphine, morphinone, oripavine, neopinone, neopine, neomorphine, hydrocodone, dihydrocodeine, 14-hydroxycodeinone, oxycodone, 14-hydroxycodeine, morphinone, hydromorphone, dihydromorphine, dihydroetorphine, ethylmorphine, etorphine, metopon, buprenorphine, pholcodine, heterocodeine, and oxymorphone.

Bisbenzylisoquinolines may include, but are not limited to, berbamunine, guattegaumerine, dauricine, and liensinine.

Nal-opioids may include, but are not limited to, naltrexone, naloxone, nalmefene, nalorphine, nalorphine, nalodeine, naldemedine, naloxegol, 6β-naltrexol, naltrindole, methylnaltrexone, methylsamidorphan, alvimopan, axelopran, bevenpran, dinicotinate, levallorphan, samidorphan, buprenorphine, dezocine, eptazocine, butorphanol, levorphanol, nalbuphine, pentazocine, phenazocine, norbinaltorphimine, and diprenorphine.

Nor-opioids may include, but are not limited to, norcodeine, noroxycodone, northebaine, norhydrocodone, nordihydro-codeine, nor-14-hydroxy-codeine, norcodeinone, nor-14-hydroxy-codeinone, normorphine, noroxymorphone, nororipavine, norhydro-morphine, nordihydro-morphine, nor-14-hydroxy-morphine, normorphinone, and nor-14-hydroxy-morphinone.

In certain embodiments, the engineered strains of the invention may provide a platform for producing compounds related to tetrahydrobiopterin synthesis including, but not limited to, dihydroneopterin triphosphate, 6-pyruvoyl tetrahydropterin, 5,6,7,8-tetrahydrobiopterin, 7,8-dihydrobiopterin, tetrahydrobiopterin 4a-carbinolamine, quinonoid dihydrobiopterin, and biopterin.

Host Cells

Any convenient cells may be utilized in the subject host cells and methods. In some cases, the host cells are non-plant cells. In some instances, the host cells may be characterized as microbial cells. In certain cases, the host cells are insect cells, mammalian cells, bacterial cells, fungal cells, or yeast cells. Any convenient type of host cell may be utilized in producing the subject BIA-producing cells, see, e.g., US2008/0176754, US2014/0273109, PCT/US2014/063738, PCT/US2016/030808, PCT/US2015/060891, PCT/US2016/031506, and PCT/US2017/057237, the disclosures of which are incorporated by reference in their entirety. Host cells of interest include, but are not limited to, bacterial cells, such as *Bacillus subtilis, Escherichia coli, Streptomyces, Anabaena, Arthrobacter, Acetobacter, Acetobacterium, Bacillus, Bifidobacterium, Brachybacterium, Brevibacterium, Carnobacterium, Clostridium, Corynebacterium, Enterobacter, Escherichia, Gluconacetobacter, Gluconobacter, Hafnia, Halomonas, Klebsiella, Kocuria, Lactobacillus, Leuconostoc, Macrococcus, Methylomonas, Methylobacter, Methylocella, Methylococcus, Microbacterium, Micrococcus, Microcystis, Moorella, Oenococcus, Pediococcus, Prochlorococcus, Propionibacterium, Proteus, Pseudoalteromonas, Pseudomonas, Psychrobacter, Rhodobacter, Rhodococcus, Rhodopseudomonas, Serratia, Staphylococcus, Streptococcus, Streptomyces, Synechococcus, Synechocystis, Tetragenococcus, Weissella, Zymomonas*, and *Salmonella typhimuium* cells, insect cells such as *Drosophila melanogaster* S2 and *Spodoptera frugiperda* Sf9 cells, and yeast cells such as *Saccharomyces cerevisiae, Schizosaccharomyces pombe*, and *Pichia pastoris* cells. In some examples, the host cells are yeast cells or *E. coli* cells. In some cases, the host cell is a yeast cell. In some instances, the host cell is from a strain of yeast engineered to produce a BIA of interest, such as a (R)-1-benzylisoquinoline alkaloid. In some instances, the host cell is from a strain of yeast engineered to produce enzymes of interest. In some instances, the host cell is from a strain of yeast engineered to produce an engineered epimerase. In some embodiments, an engineered epimerase may be an engineered split epimerase. In some embodiments, an engineered epimerase may be an engineered fused epimerase. In some embodiments, epimerase activity may be encoded by separate oxidase and reductase enzymes. Additionally, in some embodiments an engineered epimerase may be able to more efficiently convert a (S)-1-benzylisoquinoline alkaloid to a (R)-1-benzylisoquinoline alkaloid relative to a parent epimerase. In some embodiments, a parent epimerase may be a wild-type epimerase. In some embodiments, a parent epimerase may be substantially similar to a wild-type epimerase. In some cases, a parent epimerase that is substantially similar to a wild-type epimerase may have an amino acid sequence that is at least 75% or more, 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more, or 99% or more similar to an amino acid sequence of a wild-type epimerase. In some embodiments, an engineered epimerase may be separated into smaller enzymes that exhibit oxidase and reductase activities that more efficiently convert a (S)-1-benzylisoquinoline alkaloid to a (R)-1-benzylisoquinoline alkaloid relative to its corresponding parent epimerase.

In some instances, the host cell is from a strain of yeast engineered to produce a thebaine synthase. The thebaine synthase may be able to more efficiently convert a salutaridinol-7-O-acetate to a thebaine relative to a spontaneous reaction. In some instances, the host cell is from a strain of yeast engineered to produce an engineered thebaine synthase. In some embodiments, an engineered thebaine synthase may be an engineered fusion enzyme. Additionally, the engineered thebaine synthase may be able to more efficiently convert a salutaridinol-7-O-acetate to a thebaine relative to a parent thebaine synthase. In some embodiments, the parent thebaine synthase may be a wild-type thebaine synthase. In some embodiments, a parent thebaine synthase may be substantially similar to a wild-type thebaine synthase. In some cases, a parent thebaine synthase that is substantially similar to a wild-type thebaine synthase may have an amino acid sequence that is at least 75% or more, 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more, or 99% or more similar to an amino acid sequence of a wild-type thebaine synthase. The engineered thebaine synthase may be engineered as a fusion enzyme to another enzyme to more efficiently convert a salutaridinol-7-O-acetate to a thebaine relative to the parent thebaine synthase.

Any of the host cells described in US2008/0176754, US2014/0273109, PCTUS2014/063738, PCT/US2016/030808, PCT/US2015/060891, PCT/US2016/031506, PCT/US2017/057237, and U.S. Provisional Application No. 62/627,264 by Smolke et al. may be adapted for use in the subject cells and methods. In certain embodiments, the yeast cells may be of the species *Saccharomyces cerevisiae* (*S. cerevisiae*). In certain embodiments, the yeast cells may be of the species *Schizosaccharomyces pombe*. In certain embodiments, the yeast cells may be of the species *Pichia pastoris*. Yeast is of interest as a host cell because cytochrome P450 proteins are able to fold properly into the endoplasmic reticulum membrane so that their activity is maintained. In examples, cytochrome P450 proteins are involved in some biosynthetic pathways of interest. In additional examples, cytochrome P450 proteins are involved in the production of BIAs of interest. In further examples, cytochrome P450 proteins are involved in the production of an enzyme of interest.

Yeast strains of interest that find use in the invention include, but are not limited to, CEN.PK (Genotype: MATa/α ura3-52/ura3-52 trp1-289/trp1-289 leu2-3_112/leu2-3_112 his3 Δ1/his3 Δ1 MAL2-8C/MAL2-8C SUC2/SUC2), S288C, W303, D273-10B, Σ2180, A364A, Y1278B, AB972, SK1, and FL100. In certain cases, the yeast strain is any of S288C (MATα; SUC2 mal mel gal2 CUP1 flo1 flo8-1 hap1), BY4741 (MATα; his3Δ1; leu2Δ0; met15Δ0; ura3Δ0), BY4742 (MATα; his3Δ1; leu2Δ0; lys2Δ0; ura3Δ0), BY4743 (MATα/MATα; his3Δ1/his3Δ1; leu2Δ0/leu2Δ0; met15Δ0/MET15; LYS2/lys2Δ0; ura3Δ0/ura3Δ0), and WAT11 or W(R), derivatives of the W303-B strain (MATa; ade2-1; his3-11, -15; leu2-3, -112; ura3-1; canR; cyr+) which express the *Arabidopsis thaliana* NADPH-P450 reductase ATR1 and the yeast NADPH-P450 reductase CPR1, respectively. In another embodiment, the yeast cell is W303alpha (MATα; his3-11,15 trp1-1 leu2-3 ura3-1 ade2-1). The identity and genotype of additional yeast strains of interest may be found at EUROSCARF (web.uni-frankfurt.de/fb15/mikro/euroscarf/col_index.html).

In some instances, the host cell is a fungal cell. In certain embodiments, the fungal cells may be of the *Aspergillus* species and strains include *Aspergillus niger* (ATCC 1015, ATCC 9029, CBS 513.88), *Aspergillus oryzae* (ATCC 56747, RIB40), *Aspergillus terreus* (NIH 2624, ATCC 20542) and *Aspergillus nidulans* (FGSC A4).

In certain embodiments, heterologous coding sequences may be codon optimized for expression in *Aspergillus* sp. and expressed from an appropriate promoter. In certain embodiments, the promoter may be selected from phosphoglycerate kinase promoter (PGK), MbfA promoter, cytochrome c oxidase subunit promoter (CoxA), SrpB promoter, TvdA promoter, malate dehydrogenase promoter (MdhA), beta-mannosidase promoter (ManB). In certain embodiments, a terminator may be selected from glucoamylase terminator (GlaA) or TrpC terminator. In certain embodiments, the expression cassette consisting of a promoter, heterologous coding sequence, and terminator may be expressed from a plasmid or integrated into the genome of the host. In certain embodiments, selection of cells maintaining the plasmid or integration cassette may be performed with antibiotic selection such as hygromycin or nitrogen source utilization, such as using acetamide as a sole nitrogen source. In certain embodiments, DNA constructs may be introduced into the host cells using established transformation methods such as protoplast transformation, lithium acetate, or electroporation. In certain embodiments, cells may be cultured in liquid ME or solid MEA (3% malt extract, 0.5% peptone, and ±1.5% agar) or in Vogel's minimal medium with or without selection.

In some instances, the host cell is a bacterial cell. The bacterial cell may be selected from any bacterial genus. Examples of genuses from which the bacterial cell may come include *Anabaena, Arthrobacter, Acetobacter, Acetobacterium, Bacillus, Bifidobacterium, Brachybacterium, Brevibacterium, Carnobacterium, Clostridium, Corynebacterium, Enterobacter, Escherichia, Gluconacetobacter, Gluconobacter, Hafnia, Halomonas, Klebsiella, Kocuria, Lactobacillus, Leucononstoc, Macrococcus, Methylomonas, Methylobacter, Methylocella, Methylococcus, Microbacterium, Micrococcus, Microcystis, Moorella, Oenococcus, Pediococcus, Prochlorococcus, Propionibacterium, Proteus, Pseudoalteromonas, Pseudomonas, Psychrobacter, Rhodobacter, Rhodococcus, Rhodopseudomonas, Serratia, Staphylococcus, Streptococcus, Streptomyces, Synechococcus, Synechocystis, Tetragenococcus, Weissella,* and *Zymomonas.* Examples of bacterial species which may be used with the methods of this disclosure include *Arthrobacter nicotianae, Acetobacter aceti, Arthrobacter arilaitensis, Bacillus cereus, Bacillus coagulans, Bacillus licheniformis, Bacillus pumilus, Bacillus sphaericus, Bacillus stearothermophilus, Bacillus subtilis, Bifidobacterium adolescentis, Brachybacterium tyrofermentans, Brevibacterium linens, Carnobacterium divergens, Corynebacterium flavescens, Enterococcus faecium, Gluconacetobacter europaeus, Gluconacetobacter johannae, Gluconobacter oxydans, Hafnia alvei, Halomonas elongata, Kocuria rhizophila, Lactobacillus acidifarinae, Lactobacillus jensenii, Lactococcus lactis, Lactobacillus yamanashiensis, Leuconostoc citreum, Macrococcus caseolyticus, Microbacterium foliorum, Micrococcus lylae, Oenococcus oeni, Pediococcus acidilactici, Propionibacterium acidipropionici, Proteus vulgaris, Pseudomonas fluorescens, Psychrobacter celer, Staphylococcus condimenti, Streptococcus thermophilus, Streptomyces griseus, Tetragenococcus halophilus, Weissella cibaria, Weissella koreensis, Zymomonas mobilis, Corynebacterium glutamicum, Bifidobacterium bifidum/breve/longum, Streptomyces lividans, Streptomyces coelicolor, Lactobacillus plantarum, Lactobacillus sakei, Lactobacillus casei, Pseudoalteromonas citrea, Pseudomonas putida, Clostridium ljungdahlii/aceticum/acetobutylicum/beijerinckii/butyricum,* and *Moorella themocellum/thermoacetica.*

In certain embodiments, the bacterial cells may be of a strain of *Escherichia coli*. In certain embodiments, the strain of *E. coli* may be selected from BL21, DH5α, XL1-Blue, HB101, BL21, and K12. In certain embodiments, heterologous coding sequences may be codon optimized for expression in *E. coli* and expressed from an appropriate promoter. In certain embodiments, the promoter may be selected from T7 promoter, tac promoter, trc promoter, tetracycline-inducible promoter (tet), lac operon promoter (lac), lacO1 promoter. In certain embodiments, the expression cassette consisting of a promoter, heterologous coding sequence, and terminator may be expressed from a plasmid or integrated into the genome. In certain embodiments, the plasmid is selected from pUC19 or pBAD. In certain embodiments, selection of cells maintaining the plasmid or integration cassette may be performed with antibiotic selection such as kanamycin, chloramphenicol, streptomycin, spectinomycin, gentamycin, erythromycin or ampicillin. In certain embodiments, DNA constructs may be introduced into the host cells using established transformation methods such as conjugation, heat shock chemical transformation, or electroporation. In certain embodiments, cells may be cultured in liquid Luria-Bertani (LB) media at about 37° C. with or without antibiotics.

In certain embodiments, the bacterial cells may be a strain of *Bacillus subtilis*. In certain embodiments, the strain of *B. subtilis* may be selected from 1779, GP25, RO—NN-1, 168, BSn5, BEST195, 1A382, and 62178. In certain embodiments, heterologous coding sequences may be codon optimized for expression in *Bacillus* sp. and expressed from an appropriate promoter. In certain embodiments, the promoter may be selected from grac promoter, p43 promoter, or trnQ promoter. In certain embodiments, the expression cassette consisting of the promoter, heterologous coding sequence, and terminator may be expressed from a plasmid or integrated into the genome. In certain embodiments, the plasmid is selected from pHP13 pE194, pC194, pHT01, or pHT43. In certain embodiments, integrating vectors such as pDG364 or pDG1730 may be used to integrate the expression cassette into the genome. In certain embodiments, selection of cells maintaining the plasmid or integration cassette may be performed with antibiotic selection such as erythromycin, kanamycin, tetracycline, and spectinomycin. In certain embodiments, DNA constructs may be introduced into the host cells using established transformation methods such as natural competence, heat shock, or chemical transformation. In certain embodiments, cells may be cultured in liquid Luria-Bertani (LB) media at 37° C. or M9 medium plus glucose and tryptophan.

Genetic Modifications to Host Cells

The host cells may be engineered to include one or more modifications (such as two or more, three or more, four or more, five or more, or even more modifications) that provide for the production of BIAs of interest. Additionally or alternatively, the host cells may be engineered to include one or more modifications (such as two or more, three or more, four or more, five or more, or even more modifications) that provide for the production of enzymes of interest. In some cases, a modification is a genetic modification, such as a mutation, addition, or deletion of a gene or fragment thereof, or transcription regulation of a gene or fragment thereof. As used herein, the term "mutation" refers to a deletion, insertion, or substitution of an amino acid(s) residue or nucleotide(s) residue relative to a reference sequence or motif. The mutation may be incorporated as a directed mutation to the native gene at the original locus. In some cases, the mutation may be incorporated as an additional copy of the gene introduced as a genetic integration at a separate locus, or as an additional copy on an episomal vector such as a 2μ or centromeric plasmid. In certain instances, the substrate inhibited copy of the enzyme is under the native cell transcriptional regulation. In some instances, the substrate inhibited copy of the enzyme is introduced with engineered constitutive or dynamic regulation of protein expression by placing it under the control of a synthetic promoter. In some examples, the object of one or more modifications may be a native gene. In some examples, the object of one or more modifications may be a non-native gene. In some examples, a non-native gene may be inserted into a host cell. In further examples, a non-native gene may be altered by one or more modifications prior to being inserted into a host cell.

An engineered host cell may overproduce one or more BIAs of interest. By overproduce is meant that the cell has an improved or increased production of a BIA molecule of interest relative to a control cell (e.g., an unmodified cell). By improved or increased production is meant both the production of some amount of the BIA of interest where the control has no BIA of interest production, as well as an increase of about 10% or more, such as about 20% or more, about 30% or more, about 40% or more, about 50% or more, about 60% or more, about 80% or more, about 100% or more, such as 2-fold or more, such as 5-fold or more, including 10-fold or more in situations where the control has some BIA of interest production.

An engineered host cell may overproduce one or more (S)-1-benzylisoquinoline alkaloids. In some cases, the engineered host cell may produce some amount of the (S)-1-benzylisoquinoline alkaloid of interest where the control has no (S)-1-benzylisoquinoline alkaloid production, as well as an increase of about 10% or more, such as about 20% or more, about 30% or more, about 40% or more, about 50% or more, about 60% or more, about 80% or more, about 100% or more, such as 2-fold or more, such as 5-fold or more, including 10-fold or more in situations where the control has some (S)-1-benzylisoquinoline alkaloid of interest production.

An engineered host cell may further overproduce one or more (R)-1-benzylisoquinoline alkaloids. In some cases, the engineered host cell may produce some amount of the (R)-1-benzylisoquinoline alkaloid of interest where the control has no (R)-1-benzylisoquinoline alkaloid production, as well as an increase of about 10% or more, such as about 20% or more, about 30% or more, about 40% or more, about 50% or more, about 60% or more, about 80% or more, about 100% or more, such as 2-fold or more, such as 5-fold or more, including 10-fold or more in situations where the control has some (R)-1-benzylisoquinoline alkaloid of interest production. An engineered host cell may further overproduce one or more of 1-benzylisoquinoline alkaloids.

An engineered host cell may further overproduce one or more morphinan alkaloids. In some cases, the engineered host cell may produce some amount of the morphinan alkaloid of interest where the control has no morphinan alkaloid production, as well as an increase of about 10% or more, such as about 20% or more, about 30% or more, about 40% or more, about 50% or more, about 60% or more, about 80% or more, about 100% or more, such as 2-fold or more, such as 5-fold or more, including 10-fold or more in situations where the control has some morphinan alkaloid of interest production. In some cases, the morphinan alkaloid is formed from a 1-benzylisoquinoline alkaloid product, or derivative thereof, of an epimerization reaction catalyzed by an engineered epimerase within an engineered host cell. The engineered epimerase may comprise two separate enzymes that work to produce an epimerase reaction. An engineered host cell may further overproduce one or more of promorphinan, nor-opioid, or nal-opioid alkaloids.

In some cases, the engineered host cell having an engineered split epimerase is capable of producing an increased amount of (R)-reticuline relative to a host cell having an engineered fused epimerase. In some cases, the engineered host cell having modifications to an oxidase portion of an engineered epimerase is capable of producing an increased amount of (R)-reticuline relative to a control host cell that lacks the one or more modifications to the oxidase portion of the engineered epimerase (e.g., as described herein). In certain instances, the increased amount of (R)-reticuline is about 10% or more relative to the control host cell, such as about 20% or more, about 30% or more, about 40% or more, about 50% or more, about 60% or more, about 80% or more, about 100% or more, about 2-fold or more, about 5-fold or more, or even about 10-fold or more relative to the control host cell. In some cases, (R)-reticuline is the product of an epimerization reaction catalyzed by at least one engineered epimerase within an engineered host cell. In these cases, (S)-reticuline may be the substrate of the epimerization reaction.

In some cases, the engineered host cell is capable of producing an increased amount of thebaine relative to a control host cell that lacks the one or more modifications (e.g., as described herein). In some cases, the engineered host cell having a thebaine synthase is capable of producing an increased amount of thebaine relative to a host cell that lacks a thebaine synthase. In some cases, the engineered host cell having an engineered thebaine synthase is capable of producing an increased amount of thebaine relative to a host cell having a parent thebaine synthase (e.g., as described herein). In certain instances, the increased amount of thebaine is about 10% or more relative to the control host cell, such as about 20% or more, about 30% or more, about 40% or more, about 50% or more, about 60% or more, about 80% or more, about 100% or more, about 2-fold or more, about 5-fold or more, or even about 10-fold or more relative to the control host cell. In some cases, thebaine is the product of a thebaine synthase reaction within an engineered host cell. In some cases, thebaine is the product of a thebaine synthase reaction catalyzed by at least one engineered thebaine synthase within an engineered host cell. In these cases, salutaridinol-7-O-acetate may be the substrate of the thebaine synthase reaction.

Additionally, an engineered host cell may overproduce one or more enzymes of interest. By overproduce is meant that the cell has an improved or increased production of an enzyme of interest relative to a control cell (e.g., an unmodified cell). By improved or increased production is meant both the production of some amount of the enzyme of interest where the control has no production, as well as an increase of about 10% or more, such as about 20% or more, about 30% or more, about 40% or more, about 50% or more, about 60% or more, about 80% or more, about 100% or more, such as 2-fold or more, such as 5-fold or more, including 10-fold or more in situations where the control has some enzyme of interest production.

An engineered host cell may overproduce one or more engineered DRS-DRR enzymes. In some cases, the engineered host cell may produce some amount of the engineered DRS-DRR epimerase where the control has no DRS-DRR enzyme production, or where the control has a same level of production of wild-type epimerases in comparison to the engineered host cell, as well as an increase of about 10% or more, such as about 20% or more, about 30% or more, about 40% or more, about 50% or more, about 60% or more, about 80% or more, about 100% or more, such as 2-fold or more, such as 5-fold or more, including 10-fold or more in situations where the control has some DRS-DRR enzyme production. In some cases, an engineered DRS-DRR epimerase may be an engineered split epimerase. In some cases, an engineered DRS-DRR epimerase may be an engineered fused epimerase.

An engineered host cell may overproduce one or more thebaine synthase enzymes. In some cases, the engineered host cell may produce some amount of the thebaine synthase enzyme where the control has no thebaine synthase enzyme production, as well as an increase of about 10% or more, such as about 20% or more, about 30% or more, about 40% or more, about 50% or more, about 60% or more, about 80% or more, about 100% or more, such as 2-fold or more, such as 5-fold or more, including 10-fold or more in situations where the control has some thebaine synthase enzyme production.

An engineered host cell may overproduce one or more engineered thebaine synthase enzymes. In some cases, the engineered host cell may produce some amount of the engineered thebaine synthase where the control has no thebaine synthase enzyme production, or where the control has a same level of production of wild-type thebaine synthase in comparison to the engineered host cell, as well as an increase of about 10% or more, such as about 20% or more, about 30% or more, about 40% or more, about 50% or more, about 60% or more, about 80% or more, about 100% or more, such as 2-fold or more, such as 5-fold or more, including 10-fold or more in situations where the control has some thebaine synthase enzyme production. In some cases, an engineered thebaine synthase may be an engineered fusion enzyme.

An engineered host cell may further overproduce one or more enzymes that are derived from the thebaine synthase enzyme. In some cases, the engineered host cell may produce some amount of the enzymes that are derived from the thebaine synthase enzyme, where the control has no production of enzymes that are derived from the thebaine synthase enzyme, as well as an increase of about 10% or more, such as about 20% or more, about 30% or more, about 40% or more, about 50% or more, about 60% or more, about 80% or more, about 100% or more, such as 2-fold or more, such as 5-fold or more, including 10-fold or more in situations where the control has some production of enzymes that are derived from the thebaine synthase enzyme.

Additionally, an engineered host cell may overproduce one or more bisbenzylisoquinoline alkaloids (bisBIAs). In particular, an engineered host cell is capable of producing an increased amount of bisbenzylisoquinoline alkaloids (bisBIAs) relative to a control host cell that lacks the one or more modifications (e.g., as described herein), including modifications related to harboring an engineered epimerase. In certain instances, the increased amount of bisBIAs is about 10% or more relative to the control host cell, such as about 20% or more, about 30% or more, about 40% or more, about 50% or more, about 60% or more, about 80% or more, about 100% or more, about 2-fold or more, about 5-fold or more, or even about 10-fold or more relative to the control host cell. In some cases, the bisBIA is formed from at least one BIA monomer that is the product, or derivative thereof, of an epimerization reaction catalyzed by an engineered epimerase within an engineered host cell. The engineered epimerase may comprise two separate enzymes that work to produce an epimerase reaction. An engineered host cell may further overproduce one or more of cepharanthine, fangchinoline, liensinine, neferine, tubocurarine, dauricine, tetrandrine, curine, berbamunine, guattegaumerine, 2'-norberbamunine, and berbamine.

In some cases, the one or more (such as two or more, three or more, or four or more) modifications may be selected from: a localization mutation; a cytochrome P450 reductase interaction mutation; an accessibility mutation; an activity enhancing mutation; an engineered fused epimerase modification; an engineered fused thebaine synthase modification; and an engineered split epimerase modification. A cell that includes one or more modifications may be referred to as an engineered cell.

Substrate Inhibition Alleviating Mutations

In some instances, the engineered host cells are cells that include one or more substrate inhibition alleviating mutations (such as two or more, three or more, four or more, five or more, or even more) in one or more biosynthetic enzyme genes of the cell. In some examples, the one or more biosynthetic enzyme genes are native to the cell (e.g., is present in an unmodified cell). In some examples, the one or more biosynthetic enzyme genes are non-native to the cell. As used herein, the term "substrate inhibition alleviating mutation" refers to a mutation that alleviates a substrate inhibition control mechanism of the cell.

A mutation that alleviates substrate inhibition reduces the inhibition of a regulated enzyme in the cell of interest relative to a control cell and provides for an increased level of the regulated compound or a downstream biosynthetic product thereof. In some cases, by alleviating inhibition of the regulated enzyme is meant that the $IC_{50}$ of inhibition is increased by 2-fold or more, such as by 3-fold or more, 5-fold or more, 10-fold or more, 30-fold or more, 100-fold or more, 300-fold or more, 1000-fold or more, or even more. By increased level is meant a level that is 110% or more of that of the regulated compound in a control cell or a downstream product thereof, such as 120% or more, 130% or more, 140% or more, 150% or more, 160% or more, 170% or more, 180% or more, 190% or more, or 200% or more, such as at least 3-fold or more, at least 5-fold or more, at least 10-fold or more or even more of the regulated compound in the engineered host cell or a downstream product thereof.

A variety of substrate inhibition control mechanisms and biosynthetic enzymes in the engineered host cell that are directed to regulation of levels of BIAs of interest, or precursors thereof, may be targeted for substrate inhibition alleviation. The engineered host cell may include one or more substrate inhibition alleviating mutations in one or more biosynthetic enzyme genes. The one or more mutations may be located in any convenient biosynthetic enzyme genes where the biosynthetic enzyme is subject to regulatory control.

In some embodiments, the one or more biosynthetic enzyme genes encode one or more tyrosine hydroxylase enzymes. In certain instances, the one or more substrate inhibition alleviating mutations are present in a biosynthetic enzyme gene that is TyrH. In some embodiments, the engineered host cell may include one or more substrate inhibition alleviating mutations in one or more biosynthetic enzyme genes such as one of those genes described in Table 3.

In certain embodiments, the one or more substrate inhibition alleviating mutations are present in the TyrH gene. The TyrH gene encodes tyrosine hydroxylase, which is an enzyme that converts tyrosine to L-DOPA. However, TyrH is inhibited by its substrate, tyrosine. Mammalian tyrosine hydroxylase activity, such as that seen in humans or rats, can be improved through mutations to the TyrH gene that relieve substrate inhibition. In particular, substrate inhibition from tyrosine can be relieved by a point mutation W166Y in the TyrH gene. The point mutation W166Y in the TyrH gene may also improve the binding of the cosubstrate of tyrosine hydroxylase, $BH_4$, to catalyze the reaction of tyrosine to L-DOPA. The mutants of TyrH, when expressed in yeast strains to produce BIAs from sugar (such as those described in U.S. Provisional Patent Application Ser. No. 61/899,496) can significantly improve the production of BIAs.

Any convenient numbers and types of mutations may be utilized to alleviate a substrate inhibition control mechanism. In certain embodiments, the engineered host cells of the present invention may include 1 or more, 2 or more, 3 or more, 4 or more, 5 or more, 6 or more, 7 or more, 8 or more, 9 or more, 10 or more, 11 or more, 12 or more, 13 or more, 14 or more, or even 15 or more substrate inhibition alleviating mutations, such as 1, 2, 3, 4, 5, 6, 7, 8, 9, 10, 11, 12, 13, 14 or 15 substrate inhibition alleviating mutations in one or more biosynthetic enzyme genes within the engineered host cell.

Cofactor Recovery Promoting Mechanisms

In some instances, the engineered host cells are cells that include one or more cofactor recovery promoting mechanisms (such as two or more, three or more, four or more, five or more, or even more) in one or more biosynthetic enzyme genes of the cell. In some examples, the one or more biosynthetic enzyme genes are native to the cell (e.g., is present in an unmodified cell). In some examples, the one or more biosynthetic enzyme genes are non-native to the cell. As used herein, the term "cofactor recovery promoting mechanism" refers to a mechanism that promotes a cofactor recovery control mechanism of the cell.

A variety of cofactor recovery control mechanisms and biosynthetic enzymes in the engineered host cell that are directed to regulation of levels of BIAs of interest, or precursors thereof, may be targeted for cofactor recovery promotion. The engineered host cell may include one or more cofactor recovery promoting mechanism in one or more biosynthetic enzyme genes. In examples, the engineered host cell may include a heterologous coding sequence that encodes dihydrofolate reductase (DHFR). When DHFR is expressed, it may convert 7,8-dihydrobiopterin ($BH_2$) to the tetrahydrobiopterin ($BH_4$), thereby recovering $BH_4$ as a TyrH cosubstrate. In some examples, the engineered host cell may include one or more cofactor recovery promoting mechanisms in one or more biosynthetic enzyme genes such as one of those genes described in Table 2.

Any convenient numbers and types of mechanisms may be utilized to promote a cofactor recovery control mechanism. In certain embodiments, the engineered host cells of the present invention may include 1 or more, 2 or more, 3 or more, 4 or more, 5 or more, 6 or more, 7 or more, 8 or more, 9 or more, 10 or more, 11 or more, 12 or more, 13 or more, 14 or more, or even 15 or more cofactor recovery promoting mechanisms such as 1, 2, 3, 4, 5, 6, 7, 8, 9, 10, 11, 12, 13, 14 or 15 cofactor recovery promoting mechanisms in one or more biosynthetic enzyme genes within the engineered host cell.

Product Inhibition Alleviating Mutations

In some instances, the engineered host cells are cells that include one or more product inhibition alleviating mutations (such as two or more, three or more, four or more, five or more, or even more) in one or more biosynthetic enzyme genes of the cell. In some examples, the one or more biosynthetic enzyme genes are native to the cell (e.g., is present in an unmodified cell). In some examples, the one or more biosynthetic enzyme genes are non-native to the cell. As used herein, the term "product inhibition alleviating mutation" refers to a mutation that alleviates a short term and/or long term product inhibition control mechanism of an engineered host cell. Short term product inhibition is a control mechanism of the cell in which there is competitive binding at a cosubstrate binding site. Long term product inhibition is a control mechanism of the cell in which there is irreversible binding of a compound away from a desired pathway.

A mutation that alleviates product inhibition reduces the inhibition of a regulated enzyme in the cell of interest relative to a control cell and provides for an increased level of the regulated compound or a downstream biosynthetic product thereof. In some cases, by alleviating inhibition of the regulated enzyme is meant that the $IC_{50}$ of inhibition is increased by 2-fold or more, such as by 3-fold or more, 5-fold or more, 10-fold or more, 30-fold or more, 100-fold or more, 300-fold or more, 1000-fold or more, or even more. By increased level is meant a level that is 110% or more of that of the regulated compound in a control cell or a downstream product thereof, such as 120% or more, 130% or more, 140% or more, 150% or more, 160% or more, 170% or more, 180% or more, 190% or more, or 200% or more, such as at least 3-fold or more, at least 5-fold or more, at least 10-fold or more or even more of the regulated compound in the engineered host cell or a downstream product thereof.

A variety of product inhibition control mechanisms and biosynthetic enzymes in the engineered host cell that are directed to regulation of levels of BIAs of interest may be targeted for product inhibition alleviation. The engineered host cell may include one or more product inhibition alleviating mutations in one or more biosynthetic enzyme genes.

The mutation may be located in any convenient biosynthetic enzyme genes where the biosynthetic enzyme is subject to regulatory control. In some embodiments, the one or more biosynthetic enzyme genes encode one or more tyrosine hydroxylase enzymes. In certain instances, the one or more product inhibition alleviating mutations are present in a biosynthetic enzyme gene that is TyrH. In some embodiments, the engineered host cell includes one or more product inhibition alleviating mutations in one or more biosynthetic enzyme genes such as one of those genes described in Table 3.

In certain embodiments, the one or more product inhibition alleviating mutations are present in the TyrH gene. The TyrH gene encodes tyrosine hydroxylase, which is an enzyme that converts tyrosine to L-DOPA. TyrH requires tetrahydrobiopterin ($BH_4$) as a cosubstrate to catalyze the hydroxylation reaction. Some microbial strains, such as Saccharomyces cerevisiae, do not naturally produce $BH_4$, but can be engineered to produce this substrate through a four-enzyme synthesis and recycling pathway, as illustrated in FIG. 1. FIG. 1 illustrates examples of synthesis, recycling, and salvage pathways of tetrahydrobiopterin, in accordance with embodiments of the invention. FIG. 1 provides the use of the enzymes PTPS, pyruvoyl tetrahydropterin synthase; SepR, sepiapterin reductase; PCD, pterin 4a-carbinolamine dehydratase; QDHPR, dihydropteridine reductase; and DHFR, dihydrofolate reductase. Of the enzymes that are illustrated in FIG. 1, yeast synthesizes an endogenous GTP cyclohydrolase I. GTP and dihydroneopterin triphosphate are naturally synthesized in yeast. Additionally, other metabolites in FIG. 1 are not naturally produced in yeast.

TyrH is inhibited by its product L-DOPA, as well as other catecholamines, particularly dopamine. Mammalian tyrosine hydroxylase activity, such as from humans or rats, can be improved through mutations that relieve product inhibition. For example, short term product inhibition, such as competitive binding at the cosubstrate binding site, can be relieved by a point mutation W166Y on the TyrH gene. In particular, the point mutation W166Y on the TyrH gene may improve binding of the cosubstrate. Additionally, short term product inhibition to relieve competitive binding at the cosubstrate binding site may be improved by a point mutation S40D on the TyrH gene. Short term product inhibition may also be improved by the joint mutations of R37E, R38E on the TyrH gene. In particular, R37E, R38E mutations may together specifically improve tyrosine hydroxylase activity in the presence of dopamine.

Additionally, long term product inhibition may be relieved by point mutations on the TyrH gene. Long term product inhibition relief may include the irreversible binding of catecholamine to iron in the active site such that there is less catecholamine present to act as a product inhibitor of tyrosine hydroxylase activity. Long term product inhibition can be relieved by the mutations E332D and Y371F, respectively, in the TyrH gene.

Combinations of the mutations can be made (such as two or three or more mutations at once) to relieve multiple types of substrate and product inhibition to further improve the activity of TyrH. The mutants of TyrH, when expressed in yeast strains to produce BIAs from sugar (such as those described in U.S. Provisional Patent Application Ser. No. 61/899,496) can significantly improve the production of BIAs.

Any convenient numbers and types of mutations may be utilized to alleviate a product inhibition control mechanism. In certain embodiments, the engineered host cells of the present invention may include 1 or more, 2 or more, 3 or more, 4 or more, 5 or more, 6 or more, 7 or more, 8 or more, 9 or more, 10 or more, 11 or more, 12 or more, 13 or more, 14 or more, or even 15 or more product inhibition alleviating mutations, such as 1, 2, 3, 4, 5, 6, 7, 8, 9, 10, 11, 12, 13, 14 or 15 product inhibition alleviating mutations in one or more biosynthetic enzyme genes within the engineered host cell.

Feedback Inhibition Alleviating Mutations

In some instances, the engineered host cells are cells that include one or more feedback inhibition alleviating mutations (such as two or more, three or more, four or more, five or more, or even more) in one or more biosynthetic enzyme genes of the cell. In some cases, the one or more biosynthetic enzyme genes are native to the cell (e.g., is present in an unmodified cell). Additionally or alternatively, in some examples the one or more biosynthetic enzyme genes are non-native to the cell. As used herein, the term "feedback inhibition alleviating mutation" refers to a mutation that alleviates a feedback inhibition control mechanism of an engineered host cell. Feedback inhibition is a control mechanism of the cell in which an enzyme in the synthetic pathway of a regulated compound is inhibited when that compound has accumulated to a certain level, thereby balancing the amount of the compound in the cell. A mutation that alleviates feedback inhibition reduces the inhibition of a regulated enzyme in the engineered host cell relative to a control cell. In this way, engineered host cell provides for an increased level of the regulated compound or a downstream biosynthetic product thereof. In some cases, by alleviating inhibition of the regulated enzyme is meant that the $IC_{50}$ of inhibition is increased by 2-fold or more, such as by 3-fold or more, 5-fold or more, 10-fold or more, 30-fold or more, 100-fold or more, 300-fold or more, 1000-fold or more, or even more. By increased level is meant a level that is 110% or more of that of the regulated compound in a control cell or a downstream product thereof, such as 120% or more, 130% or more, 140% or more, 150% or more, 160% or more, 170% or more, 180% or more, 190% or more, or 200% or more, such as at least 3-fold or more, at least 5-fold or more, at least 10-fold or more or even more of the regulated compound in the host cell or a downstream product thereof.

A variety of feedback inhibition control mechanisms and biosynthetic enzymes that are directed to regulation of levels of BIAs of interest may be targeted for alleviation in the host cell. The host cell may include one or more feedback inhibition alleviating mutations in one or more biosynthetic enzyme genes native to the cell. The one or more mutations may be located in any convenient biosynthetic enzyme genes where the biosynthetic enzyme is subject to regulatory control. In some embodiments, the one or more biosynthetic enzyme genes may encode one or more enzymes selected from a 3-deoxy-d-arabinose-heptulosonate-7-phosphate (DAHP) synthase and a chorismate mutase. In some embodiments, the one or more biosynthetic enzyme genes encode a 3-deoxy-d-arabinose-heptulosonate-7-phosphate (DAHP) synthase. In some instances, the one or more biosynthetic enzyme genes may encode a chorismate mutase. In certain instances, the one or more feedback inhibition alleviating mutations may be present in a biosynthetic enzyme gene selected from ARO4 and ARO7. In certain instances, the one or more feedback inhibition alleviating mutations may be present in a biosynthetic enzyme gene that is ARO4. In certain instances, the one or more feedback inhibition alleviating mutations are present in a biosynthetic enzyme gene that is ARO7. In some embodiments, the engineered host cell may include one or more feedback inhibition alleviating mutations in one or more biosynthetic enzyme genes such as one of those genes described in Table 3.

Any convenient numbers and types of mutations may be utilized to alleviate a feedback inhibition control mechanism. As used herein, the term "mutation" refers to a deletion, insertion, or substitution of an amino acid(s) residue or nucleotide(s) residue relative to a reference sequence or motif. The mutation may be incorporated as a directed mutation to the native gene at the original locus. In some cases, the mutation may be incorporated as an additional copy of the gene introduced as a genetic integration at a separate locus, or as an additional copy on an episomal vector such as a 2μ or centromeric plasmid. In certain instances, the feedback inhibited copy of the enzyme is under the native cell transcriptional regulation. In some instances, the feedback inhibited copy of the enzyme is introduced with engineered constitutive or dynamic regulation of protein expression by placing it under the control of a synthetic promoter.

In certain embodiments, the one or more feedback inhibition alleviating mutations may be present in the ARO4 gene. ARO4 mutations of interest may include, but are not limited to, substitution of the lysine residue at position 229 with a leucine, a substitution of the glutamine residue at position 166 with a lysine residue, or a mutation as described by Hartmann M, et al. ((2003) Proc Natl Acad Sci USA 100(3):862-867) or Fukuda et al. ((1992) J Ferment Bioeng 74(2):117-119). In some instances, mutations for conferring feedback inhibition may be selected from a mutagenized library of enzyme mutants. Examples of such selections may include rescue of growth of o-fluoro-D,L-phenylalanine or growth of aro3 mutant yeast strains in media with excess tyrosine as described by Fukuda et al. ((1990) Breeding of Brewing Yeast Producing a Large Amount of Beta-Phenylethyl Alcohol and Beta-Phenylethyl Acetate. Agr Biol Chem Tokyo 54(1):269-271).

In certain embodiments, the engineered host cells of the present invention may include 1 or more, 2 or more, 3 or more, 4 or more, 5 or more, 6 or more, 7 or more, 8 or more, 9 or more, 10 or more, 11 or more, 12 or more, 13 or more, 14 or more, or even 15 or more feedback inhibition alleviating mutations, such as 1, 2, 3, 4, 5, 6, 7, 8, 9, 10, 11, 12, 13, 14 or 15 feedback inhibition alleviating mutations in one or more biosynthetic enzyme genes within the engineered host cell.

Transcriptional Modulation Modifications

The host cells may include one or more transcriptional modulation modifications (such as two or more, three or more, four or more, five or more, or even more modifications) of one or more biosynthetic enzyme genes of the cell. In some examples, the one or more biosynthetic enzyme genes are native to the cell. In some examples, the one or more biosynthetic enzyme genes are non-native to the cell. Any convenient biosynthetic enzyme genes of the cell may be targeted for transcription modulation. By transcription modulation is meant that the expression of a gene of interest in a modified cell is modulated, e.g., increased or decreased, enhanced or repressed, relative to a control cell (e.g., an unmodified cell). In some cases, transcriptional modulation of the gene of interest includes increasing or enhancing expression. By increasing or enhancing expression is meant that the expression level of the gene of interest is increased by 2-fold or more, such as by 5-fold or more and sometimes by 25-, 50-, or 100-fold or more and in certain embodiments 300-fold or more or higher, as compared to a control, i.e., expression in the same cell not modified (e.g., by using any convenient gene expression assay). Alternatively, in cases where expression of the gene of interest in a cell is so low that it is undetectable, the expression level of the gene of interest is considered to be increased if expression is increased to a level that is easily detectable. In certain instances, transcriptional modulation of the gene of interest includes decreasing or repressing expression. By decreasing or repressing expression is meant that the expression level of the gene of interest is decreased by 2-fold or more, such as by 5-fold or more and sometimes by 25-, 50-, or 100-fold or more and in certain embodiments 300-fold or more or higher, as compared to a control. In some cases, expression is decreased to a level that is undetectable. Modifications of host cell processes of interest that may be adapted for use in the subject host cells are described in U.S. Publication No. 20140273109 (Ser. No. 14/211,611) by Smolke et al., the disclosure of which is herein incorporated by reference in its entirety.

Figure 2:
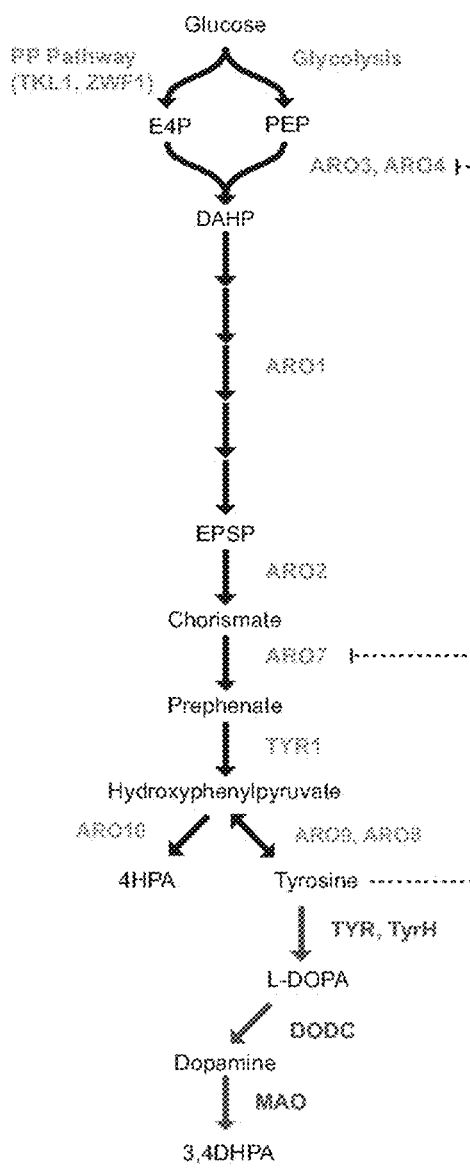
FIG. 2 illustrates a biosynthetic scheme for conversion of glucose to 4-HPA, dopamine, and 3,4-DHPA, in accordance with embodiments of the invention.

Any convenient biosynthetic enzyme genes may be transcriptionally modulated, and include but are not limited to, those biosynthetic enzymes described in FIG. 2. In particular, FIG. 2 illustrates a biosynthetic scheme for conversion of glucose to 4-HPA, dopamine, and 3,4-DHPA, in accordance with embodiments of the invention. Examples of enzymes described in FIG. 2 include ARO3, ARO4, ARO1, ARO7, TYR1, TYR, TyrH, DODC, MAO, ARO10, ARO9, ARO8, and TKL. In some instances, the one or more biosynthetic enzyme genes may be selected from ARO10, ARO9, ARO8, and TKL. In some cases, the one or more biosynthetic enzyme genes may be ARO10. In certain instances, the one or more biosynthetic enzyme genes may be ARO9. In some embodiments, the one or more biosynthetic enzyme genes may be TKL. In some embodiments, the host cell includes one or more transcriptional modulation modifications to one or more genes such as one of those genes described in Table 3.

In some embodiments, the transcriptional modulation modification may include a substitution of a strong promoter for a native promoter of the one or more biosynthetic enzyme genes or the expression of an additional copy(ies) of the gene or genes under the control of a strong promoter. The promoters driving expression of the genes of interest may be constitutive promoters or inducible promoters, provided that the promoters may be active in the host cells. The genes of interest may be expressed from their native promoters. Additionally or alternatively, the genes of interest may be expressed from non-native promoters. Although not a requirement, such promoters may be medium to high strength in the host in which they are used. Promoters may be regulated or constitutive. In some embodiments, promoters that are not glucose repressed, or repressed only mildly by the presence of glucose in the culture medium, may be used. There are numerous suitable promoters, examples of which include promoters of glycolytic genes such as the promoter of the *B. subtilis* tsr gene (encoding fructose biphosphate aldolase) or GAPDH promoter from yeast *S. cerevisiae* (coding for glyceraldehyde-phosphate dehydrogenase) (Bitter G. A., *Meth. Enzymol.* 152:673 684 (1987)). Other strong promoters of interest include, but are not limited to, the ADHI promoter of baker's yeast (Ruohonen L., et al, *J. Biotechnol.* 39:193 203 (1995)), the phosphate-starvation induced promoters such as the PHO5 promoter of yeast (Hinnen, A., et al, in *Yeast Genetic Engineering*, Barr, P. J., et al. eds, Butterworths (1989), the alkaline phosphatase promoter from *B. licheniformis* (Lee. J. W. K., et al., *J. Gen. Microbiol.* 137:1127 1133 (1991)), GPD1, and TEF1. Yeast promoters of interest include, but are not limited to, inducible promoters such as Gal1-10, Gal1, GalL, GalS, repressible promoter Met25, tetO, and constitutive promoters such as glyceraldehyde 3-phosphate dehydrogenase promoter (GPD), alcohol dehydrogenase promoter (ADH), translation-elongation factor-1-alpha promoter (TEF), cytochrome c-oxidase promoter (CYC1), MRP7 promoter, etc. In some instances, the strong promoter is GPD1. In certain instances, the strong promoter is TEF1. Autonomously replicating yeast expression vectors containing promoters inducible by hormones such as glucocorticoids, steroids, and thyroid hormones are also known and include, but are not limited to, the glucorticoid responsive element (GRE) and thyroid hormone responsive element (TRE), see e.g., those promoters described in U.S. Pat. No. 7,045,290. Vectors containing constitutive or inducible promoters such as alpha factor, alcohol oxidase, and PGH may be used. Additionally any promoter/enhancer combination (as per the Eukaryotic Promoter Data Base EPDB) could also be used to drive expression of genes of interest. It is understood that any convenient promoters specific to the host cell may be selected, e.g., *E. coli*. In some cases, promoter selection may be used to optimize transcription, and hence, enzyme levels to maximize production while minimizing energy resources.

Inactivating Mutations

The engineered host cells may include one or more inactivating mutations to an enzyme of the cell (such as two or more, three or more, four or more, five or more, or even more). The inclusion of one or more inactivating mutations may modify the flux of a synthetic pathway of an engineered host cell to increase the levels of a BIA of interest or a desirable enzyme or precursor leading to the same. In some examples, the one or more inactivating mutations are to an enzyme native to the cell. Additionally or alternatively, the one or more inactivating mutations are to an enzyme non-native to the cell. As used herein, by "inactivating mutation" is meant one or more mutations to a gene or regulatory DNA sequence of the cell, where the mutation(s) inactivates a biological activity of the protein expressed by that gene of interest. In some cases, the gene is native to the cell. In some instances, the gene encodes an enzyme that is inactivated and is part of or connected to the synthetic pathway of a BIA of interest produced by the host cell. In some instances, an inactivating mutation is located in a regulatory DNA sequence that controls a gene of interest. In certain cases, the inactivating mutation is to a promoter of a gene. Any convenient mutations (e.g., as described herein) may be utilized to inactivate a gene or regulatory DNA sequence of interest. By "inactivated" or "inactivates" is meant that a biological activity of the protein expressed by the mutated gene is reduced by 10% or more, such as by 20% or more, 30% or more, 40% or more, 50% or more, 60% or more, 70% or more, 80% or more, 90% or more, 95% or more, 97% or more, or 99% or more, relative to a control protein expressed by a non-mutated control gene. In some cases, the protein is an enzyme and the inactivating mutation reduces the activity of the enzyme.

In some examples, the engineered host cell includes an inactivating mutation in an enzyme native to the cell. Any convenient enzymes may be targeted for inactivation. Enzymes of interest may include, but are not limited to those enzymes, described in Table 3 whose action in the synthetic pathway of the engineered host cell tends to reduce the levels of a BIA of interest. In some cases, the enzyme has glucose-6-phosphate dehydrogenase activity. In certain embodiments, the enzyme that includes an inactivating mutation is ZWF1. In some cases, the enzyme has alcohol dehydrogenase activity. In some embodiments, the enzyme that includes an inactivating mutation is selected from ADH2, ADH3, ADH4, ADH5, ADH6, ADH7, and SFA1. In certain embodiments, the enzyme that includes an inactivating mutation(s) is ADH2. In certain embodiments, the enzyme that includes an inactivating mutation(s) is ADH3. In certain embodiments, the enzyme that includes an inactivating mutation(s) is ADH4. In certain embodiments, the enzyme that includes an inactivating mutation(s) is ADH5. In certain embodiments, the enzyme that includes an inactivating mutation(s) is ADH6. In certain embodiments, the enzyme that includes an inactivating mutation(s) is ADH7. In some cases, the enzyme has aldehyde oxidoreductase activity. In certain embodiments, the enzyme that includes an inactivating mutation is selected from ALD2, ALD3, ALD4, ALD5, and ALD6. In certain embodiments, the enzyme that includes an inactivating mutation(s) is ALD2. In certain embodiments, the enzyme that includes an inactivating mutation(s) is ALD3. In certain embodiments, the enzyme that includes an inactivating mutation(s) is ALD4. In certain embodiments, the enzyme that includes an inactivating mutation(s) is ALD5. In certain embodiments, the enzyme that includes an inactivating mutation(s) is ALD6. In some cases, the enzyme has aryl-alcohol dehydrogenase activity. In some embodiments, the enzyme that includes an inactivating mutation is selected from AAD4, AAD6, AAD10, AAD14, AAD15, AAD16. In certain embodiments, the enzyme that includes an inactivating mutation(s) is AAD4. In certain embodiments, the enzyme that includes an inactivating mutation(s) is AAD6. In certain embodiments, the enzyme that includes an inactivating mutation(s) is AAD10. In certain embodiments, the enzyme that includes an inactivating mutation(s) is AAD14. In certain embodiments, the enzyme that includes an inactivating mutation(s) is AAD15. In certain embodiments, the enzyme that includes an inactivating mutation(s) is AAD16. In some embodiments, the host cell includes one or more inactivating mutations to one or more genes described in Table 3.

Epimerization Modifications

Figure 3:
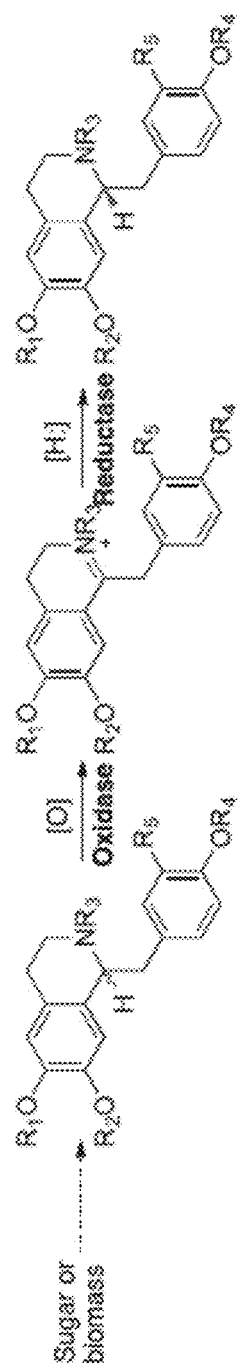
FIG. 3 illustrates a schematic example of (R)-1-benzylisoquinoline alkaloid formation, in accordance with embodiments of the invention.

Some methods, processes, and systems provided herein describe the conversion of (S)-1-benzylisoquinoline alkaloids to (R)-1-benzylisoquinoline alkaloids. Some of these methods, processes, and systems may comprise an engineered host cell. In some examples, the conversion of (S)-1-benzylisoquinoline alkaloids to (R)-1-benzylisoquinoline alkaloids is a key step in the conversion of a substrate to a diverse range of alkaloids. In some examples, the conversion of (S)-1-benzylisoquinoline alkaloids to (R)-1-benzylisoquinoline alkaloids comprises an epimerization reaction via an engineered epimerase. In some cases, epimerization of a substrate alkaloid may be performed by oxidizing an (S)-substrate to the corresponding Schiff base or imine intermediate, then stereospecifically reducing this intermediate to an (R)-product as provided in FIG. 3 and as represented generally in Scheme 1. As provided in Scheme 1, $R_1$, $R_2$, $R_3$, and $R_4$ may be H or $CH_3$. $R_5$ may be H, OH, or $OCH_3$.

Scheme 1 precursor ⟶

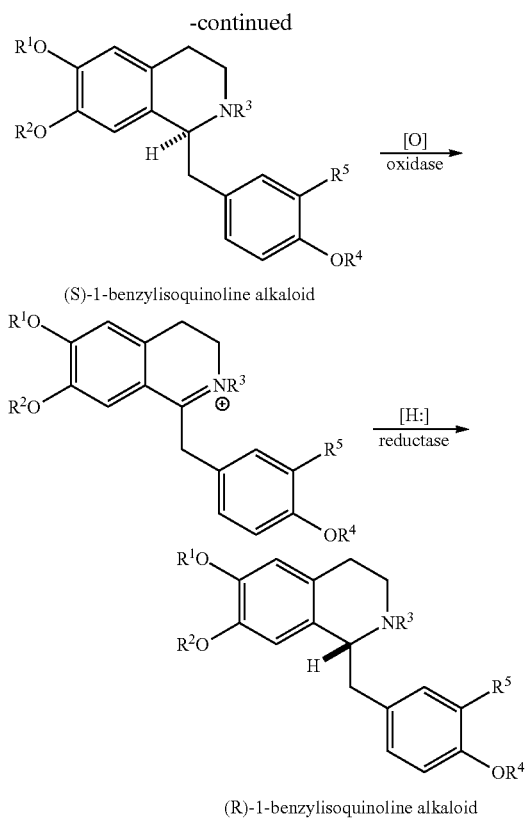

(S)-1-benzylisoquinoline alkaloid (R)-1-benzylisoquinoline alkaloid

In some examples, the conversion of the (S)-substrate to the (R)-product may involve at least one oxidation reaction and at least one reduction reaction. In some cases, an oxidation reaction is optionally followed by a reduction reaction. In some cases, at least one of the oxidation and reduction reactions is carried out in the presence of an enzyme. In some cases, at least one of the oxidation and reduction reactions is catalyzed by an engineered epimerase. In some cases, the oxidation and reduction reactions are both carried out in the presence of an engineered fused epimerase. In some cases, the oxidation and reduction reactions are both carried out in the presence of an engineered split epimerase having a separately expressed oxidase component and reductase component, respectively. In some cases, an engineered epimerase is useful to catalyze the oxidation and reduction reactions. The oxidation and reduction reactions may be catalyzed by the same engineered epimerase.

In some methods, processes and systems described herein, an oxidation reaction may be performed in the presence of an enzyme that is part of an engineered epimerase. In some examples, the engineered epimerase may have an oxidase component. In some cases, the oxidase component may be a component of an engineered fused epimerase. In some case, the oxidase component may be independently expressed as part of an engineered split epimerase. The oxidase may use a (S)-1-benzylisoquinoline as a substrate. The oxidase may convert the (S)-substrate to a corresponding imine or Schiff base derivative. The oxidase may be referred to as 1,2-dehydroreticuline synthase (DRS). Non-limiting examples of enzymes suitable for oxidation of (S)-1-benzylisoquinoline alkaloids in this disclosure include a cytochrome P450 oxidase, a 2-oxoglutarate-dependent oxidase, and a flavoprotein oxidase. For example, (S)-tetrahydroprotoberberine oxidase (STOX, E.C 1.3.3.8) may oxidize (S)-norreticuline and other (S)-1-benzylisoquinoline alkaloids to 1,2-dehydronorreticuline and other corresponding 1,2-dehydro products. In some examples, a protein that comprises an oxidase domain of any one of the preceding examples may perform the oxidation. In some examples, the oxidase may catalyze the oxidation reaction within a host cell, such as an engineered host cell, as described herein. In some cases, the oxidase may have one or more activity-increasing components as discussed herein and as described in Examples 6 and 8.

In some examples, a reduction reaction may follow the oxidation reaction. The reduction reaction may be performed by an enzyme that is part of an engineered epimerase. In some examples, the reductase may use an imine or Schiff base derived from a 1-benzylisoquinoline as a substrate. The reductase may convert the imine or Schiff base derivative to a (R)-1-benzylisoquinoline. The reductase may be referred to as 1,2-dehydroreticuline reductase (DRR). Non-limiting examples of enzymes suitable for reduction of an imine or Schiff base derived from an (S)-1-benzylisoquinoline alkaloid include an aldo-keto reductase (e.g., a codeinone reductase-like enzyme (EC 1.1.1.247)) and a short chain dehydrogenase (e.g., a salutaridine reductase-like enzyme (EC 1.1.1.248)). In some examples, a protein that comprises a reductase domain of any one of the preceding examples may perform the reduction. In a further embodiment, the reduction is stereospecific. In some examples, the reductase may catalyze the reduction reaction within a host cell, such as an engineered host cell, as described herein.

An example of an enzyme that can perform an epimerization reaction that converts (S)-1-benzylisoquinoline alkaloids to (R)-1-benzylisoquinoline alkaloids includes an epimerase having an oxidase domain and a reductase domain. In particular, the epimerase may have a cytochrome P450 oxidase 82Y2-like domain. Additionally, the epimerase may have a codeinone reductase-like domain. An epimerase having a cytochrome P450 oxidase 82Y2-like domain and also having a codeinone reductase-like domain may be referred to as a DRS-DRR enzyme. In particular, a DRS-DRR enzyme may be a fusion enzyme that is a fusion epimerase. Further, when a DRS-DRR enzyme is modified by at least one activity-increasing modification, the fusion enzyme may be an engineered fusion epimerase. Examples of activity-increasing modifications are discussed in Examples 6 and 8 below.

An example of an amino acid sequence of a DRS-DRR enzyme that may be used to perform the conversion of (S)-1-benzylisoquinoline alkaloids to (R)-1-benzylisoquinoline alkaloids is provided in FIG. 4. In particular, FIG. 4 illustrates an amino acid sequence of a DRS-DRR enzyme that has been codon-optimized, in accordance with embodiments of the invention. Further, FIG. 5 illustrates a split of an oxidase portion and reductase portion, each of the DRS-DRR enzyme of FIG. 4. Additional amino acid sequences of a DRS-DRR enzyme are set forth in Table 1. An amino acid sequence for an epimerase that is utilized in converting an (S)-1-benzylisoquinoline alkaloid to an (R)-1-benzylisoquinoline alkaloid may be 75% or more identical to a given amino acid sequence as listed in Table 1. For example, an amino acid sequence for such an epimerase may comprise an amino acid sequence that is at least 75% or more, 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more, or 99% or more identical to an amino acid sequence as provided herein. Additionally, in certain embodiments, an "identical" amino acid sequence contains at least 80%-99% identity at the amino acid level to the specific amino acid sequence. In some cases an "identical" amino acid sequence contains at least about 85%, 86%, 87%, 88%, 89%, 90%, 91%, 92%, 93%, 94% and more in certain cases, at least 95%, 96%, 97%, 98% and 99% identity, at the amino acid level. In some cases, the amino acid sequence may be identical but the DNA sequence is altered such as to optimize codon usage for the host organism, for example.

Amino acid residues of homologous epimerases may be referenced according to the numbering scheme of SEQ ID NO. 16, and this numbering system is used throughout the disclosure to refer to specific amino acid residues of epimerases which are homologous to SEQ ID NO. 16. Epimerases homologous to SEQ ID NO. 16 may have at least about 70%, 75%, 80%, 85%, 90%, 95%, 97%, 98%, or 99% sequence identity to SEQ ID NO. 16. In some cases, an amino acid referred to as position 50 in a homologous epimerase may not be the 50$^{th}$ amino acid in the homologous epimerase, but would be the amino acid which corresponds to the amino acid at position 50 in SEQ ID NO. 16 in a protein alignment of the homologous epimerase with SEQ ID NO. 16. In some cases, homologous enzymes may be aligned with SEQ ID NO. 16 either according to primary sequence, secondary structure, or tertiary structure.

An engineered host cell may be provided that produces an engineered epimerase that converts (S)-1-benzylisoquinoline alkaloid to (R)-1-benzylisoquinoline alkaloid, wherein the epimerase comprises an amino acid sequence selected from the group consisting of: SEQ ID NOs: 1, 2, 3, 4, 5, 6, 7, 8, 9, 10, 11, 12, 13, 14, 15, 16, 17, and 18, and having one or more activity-enhancing modifications as described in Table 13. The epimerase that is produced within the engineered host cell may be recovered and purified so as to form a biocatalyst. In some cases, the epimerase may be split into one or more enzymes. Additionally, one or more enzymes that are produced by splitting the epimerase may be recovered from the engineered host cell. These one or more enzymes that result from splitting the epimerase may also be used to catalyze the conversion of (S)-1-benzylisoquinoline alkaloids to (R)-1-benzylisoquinoline alkaloids. Additionally, the use of an engineered split epimerase may be used to increase the production of benzylisoquinoline alkaloid products within a cell when compared to the production of benzylisoquinoline alkaloid products within a cell utilizing a fused epimerase.

In additional cases, the one or more enzymes that are recovered from the engineered host cell that produces the epimerase may be used in a process for converting a (S)-1-benzylisoquinoline alkaloid to a (R)-1-benzylisoquinoline alkaloid. The process may include contacting the (S)-1-benzylisoquinoline alkaloid with an epimerase in an amount sufficient to convert said (S)-1-benzylisoquinoline alkaloid to (R)-1-benzylisoquinoline alkaloid. In examples, the (S)-1-benzylisoquinoline alkaloid may be contacted with a sufficient amount of the one or more enzymes such that at least 5% of said (S)-1-benzylisoquinoline alkaloid is converted to (R)-1-benzylisoquinoline alkaloid. In further examples, the (S)-1-benzylisoquinoline alkaloid may be contacted with a sufficient amount of the one or more enzymes such that at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, at least 99.5%, at least 99.7%, or 100% of said (S)-1-benzylisoquinoline alkaloid is converted to (R)-1-benzylisoquinoline alkaloid.

The one or more enzymes that may be used to convert a (S)-1-benzylisoquinoline alkaloid to a (R)-1-benzylisoquinoline alkaloid may contact the (S)-1-benzylisoquinoline alkaloid in vitro. Additionally, or alternatively, the one or more enzymes that may be used to convert a (S)-1-benzylisoquinoline alkaloid to a (R)-1-benzylisoquinoline alkaloid may contact the (S)-1-benzylisoquinoline alkaloid in vivo. Additionally, the one or more enzymes that may be used to convert a (S)-1-benzylisoquinoline alkaloid to a (R)-1-benzylisoquinoline alkaloid may be provided to a cell having the (S)-1-benzylisoquinoline alkaloid within, or may be produced within an engineered host cell.

In some examples, the methods provide for engineered host cells that produce an alkaloid product, wherein the epimerization of a (S)-substrate to a (R)-product may comprise a key step in the production of an alkaloid product. In some examples, the alkaloid produced is a (R)-1-benzylisoquinoline alkaloid. In still other embodiments, the alkaloid produced is derived from a (R)-1-benzylisoquinoline alkaloid, including, for example, 4-ring promorphinan and 5-ring morphinan alkaloids. In another embodiment, a (S)-1-benzylisoquinoline alkaloid is an intermediate toward the product of the engineered host cell. In still other embodiments, the alkaloid product is selected from the group consisting of 1-benzylisoquinoline, morphinan, promorphinan, nor-opioid, nal-opioid, or bisbenzylisoquinoline alkaloids.

In some examples, the (S)-substrate is a (S)-1-benzylisoquinoline alkaloid selected from the group consisting of (S)-norreticuline, (S)-reticuline, (S)-tetrahydropapaverine, (S)-norcoclaurine, (S)-coclaurine, (S)—N-methylcoclaurine, (S)-3'-hydroxy-N-methylcoclaurine, (S)-norisoorientaline, (S)-orientaline, (S)-isoorientaline, (S)-norprotosinomenine, (S)-protosinomenine, (S)-norlaudanosoline, (S)-laudanosoline, (S)-4'-O-methyllaudanosoline, (S)-6-O-methylnorlaudanosoline, (S)-4'-O-methylnorlaudanosoline.

In some examples, the (S)-substrate is a compound of Formula I:

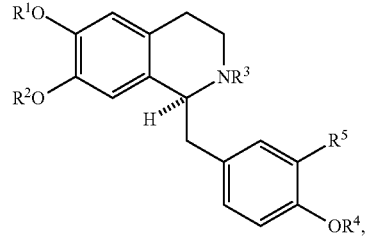

Formula I or a salt thereof, wherein:

$R^1$, $R^2$, $R^3$, and $R^4$ are independently selected from hydrogen and methyl; and $R^5$ is selected from hydrogen, hydroxy, and methoxy.

In some other examples, at least one of $R^1$, $R^2$, $R^3$, $R^4$, and $R^5$ is hydrogen.

In still other examples, the (S)-substrate is a compound of Formula II:

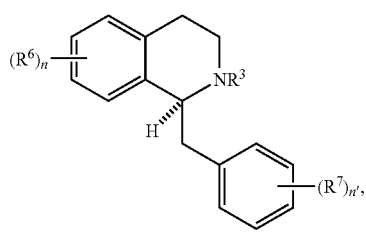

Formula II or a salt thereof, wherein:

$R^3$ is selected from hydrogen and $C_1$-$C_4$ alkyl;

$R^6$ and $R^7$ are independently selected at each occurrence from hydroxy, fluoro, chloro, bromo, carboxaldehyde, $C_1$-$C_4$ acyl, $C_1$-$C_4$ alkyl, and $C_1$-$C_4$ alkoxy;

n is 0, 1, 2, 3, or 4; and n' is 0, 1, 2, 3, 4 or 5.

When a bond is drawn across a ring, it means substitution may occur at a non-specific ring atom or position. For example, in Formula II shown above, the hydrogen of any —CH— in the 6-membered ring may be replaced with $R^7$ to form —$CR^7$—.

In some examples, $R^6$ and $R^7$ are independently methyl or methoxy. In some other examples, n and n' are independently 1 or 2. In still other embodiments, $R^3$ is hydrogen or methyl.

In some examples, the methods provide for engineered host cells that produce alkaloid products from (S)-reticuline. The epimerization of (S)-reticuline to (R)-reticuline may comprise a key step in the production of diverse alkaloid products from a precursor. In some examples, the precursor is L-tyrosine or a sugar (e.g., glucose). The diverse alkaloid products can include, without limitation, 1-benzylisoquinoline, morphinan, promorphinan, nor-opioid, or nal-opioid alkaloids.

Any suitable carbon source may be used as a precursor toward an epimerized 1-benzylisoquinoline alkaloid. Suitable precursors can include, without limitation, monosaccharides (e.g., glucose, fructose, galactose, xylose), oligosaccharides (e.g., lactose, sucrose, raffinose), polysaccharides (e.g., starch, cellulose), or a combination thereof. In some examples, unpurified mixtures from renewable feedstocks can be used (e.g., cornsteep liquor, sugar beet molasses, barley malt, biomass hydrolysate). In still other embodiments, the carbon precursor can be a one-carbon compound (e.g., methanol, carbon dioxide) or a two-carbon compound (e.g., ethanol). In yet other embodiments, other carbon-containing compounds can be utilized, for example, methylamine, glucosamine, and amino acids (e.g., L-tyrosine). In some examples, a 1-benzylisoquinoline alkaloid may be added directly to an engineered host cell of the invention, including, for example, norlaudanosoline, laudanosoline, norreticuline, and reticuline. In still further embodiments, a 1-benzylisoquinoline alkaloid may be added to the engineered host cell as a single enantiomer (e.g., a (S)-1-benzylisoquinoline alkaloid), or a mixture of enantiomers, including, for example, a racemic mixture.

In some examples, the methods provide for the epimerization of a stereocenter of a 1-benzylisoquinoline alkaloid, or a derivative thereof, using an engineered epimerase. In a further embodiment, the method comprises contacting the 1-benzylisoquinoline alkaloid with an engineered epimerase. The engineered epimerase may invert the stereochemistry of a stereocenter of a 1-benzylisoquinoline alkaloid, or derivative thereof, to the opposite stereochemistry.

In some examples, the engineered epimerase converts a (S)-1-benzylisoquinoline alkaloid to a (R)-1-benzylisoquinoline alkaloid. In some examples of this conversion of a (S)-1-benzylisoquinoline alkaloid to a (R)-1-benzylisoquinoline alkaloid utilizing the engineered epimerase, the (S)-1-benzylisoquinoline alkaloid is selected from the group consisting of (S)-norreticuline, (S)-reticuline, (S)-tetrahydropapaverine, (S)-norcoclaurine, (S)-coclaurine, (S)—N-methylcoclaurine, (S)-3'-hydroxy-N-methylcoclaurine, (S)-norisoorientaline, (S)-orientaline, (S)-isoorientaline, (S)-norprotosinomenine, (S)-protosinomenine, (S)-norlaudanosoline, (S)-laudanosoline, (S)-4'-O-methyllaudanosoline, (S)-6-O-methylnorlaudanosoline, and (S)-4'-O-methylnorlaudanosoline.

In still other embodiments, the 1-benzylisoquinoline alkaloid that is epimerized using an engineered epimerase may comprise two or more stereocenters, wherein only one of the two or more stereocenters is inverted to produce a diastereomer of the substrate (e.g., (S, R)-1-benzylisoquinoline alkaloid converted to (R, R)-1-benzylisoquinoline alkaloid). In examples where only one stereocenter of a 1-benzylisoquinoline alkaloid is inverted when contacted with the at least one enzyme, the product is referred to as an epimer of the 1-benzylisoquinoline alkaloid.

In some examples, the 1-benzylisoquinoline alkaloid is presented to the enzyme as a single stereoisomer. In some other examples, the 1-benzylisoquinoline alkaloid is presented to the enzyme as a mixture of stereoisomers. In still further embodiments, the mixture of stereoisomers may be a racemic mixture. In some other examples, the mixture of stereoisomers may be enriched in one stereoisomer as compared to another stereoisomer.

In some examples, a 1-benzylisoquinoline alkaloid, or a derivative thereof, is recovered. In some examples, the 1-benzylisoquinoline alkaloid is recovered from a cell culture. In still further embodiments, the recovered 1-benzylisoquinoline alkaloid is enantiomerically enriched in one stereoisomer as compared to the original mixture of 1-benzylisoquinoline alkaloids presented to the enzyme. In still further embodiments, the recovered 1-benzylisoquinoline alkaloid has an enantiomeric excess of at least 50%, at least 55%, at least 60%, at least 65%, at least 70%, at least 75%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, at least 99.5%, at least 99.7%, or 100%.

In some examples, a promorphinan, or a derivative thereof, is recovered. In some examples, the promorphinan is recovered from a cell culture. In still further embodiments, the recovered promorphinan has an enantiomeric excess of at least 50%, at least 55%, at least 60%, at least 65%, at least 70%, at least 75%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, at least 99.5%, at least 99.7%, or 100%.

In some examples, a morphinan, or a derivative thereof, is recovered. In some examples, the morphinan is recovered from a cell culture. In still further embodiments, the recovered morphinan has an enantiomeric excess of at least 50%, at least 55%, at least 60%, at least 65%, at least 70%, at least 75%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, at least 99.5%, at least 99.7%, or 100%.

In some examples, a bisbenzylisoquinoline, or a derivative thereof, is recovered. In some examples, the bisbenzylisoquinoline is recovered from a cell culture. In still further embodiments, the recovered bisbenzylisoquinoline is enantiomerically enriched in one stereoisomer as compared to the original mixture of bisbenzylisoquinoline presented to the enzyme. In still further embodiments, the recovered bisbenzylisoquinoline has an enantiomeric excess of at least 50%, at least 55%, at least 60%, at least 65%, at least 70%, at least 75%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, at least 99.5%, at least 99.7%, or 100%.

In some examples, a nal-opioid, or a derivative thereof, is recovered. In some examples, the nal-opioid is recovered from a cell culture. In still further embodiments, the recovered nal-opioid has an enantiomeric excess of at least 50%, at least 55%, at least 60%, at least 65%, at least 70%, at least 75%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, at least 99.5%, at least 99.7%, or 100%.

In some examples, a nor-opioid, or a derivative thereof, is recovered. In some examples, the nor-opioid is recovered from a cell culture. In still further embodiments, the recovered nor-opioid has an enantiomeric excess of at least 50%, at least 55%, at least 60%, at least 65%, at least 70%, at least 75%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, at least 99.5%, at least 99.7%, or 100%.

"Isomers" are different compounds that have the same molecular formula. "Stereoisomers" are isomers that differ only in the way the atoms are arranged in space. "Enantiomers" are a pair of stereoisomers that are non-superimposable mirror images of each other. A 1:1 mixture of a pair of enantiomers is a "racemic" mixture. "Diastereoisomers" or "diastereomers" are stereoisomers that have at least two asymmetric atoms but are not mirror images of each other. The term "epimer" as used herein refers to a compound having the identical chemical formula but a different optical configuration at a particular position. For example, the (R,S) and (S,S) stereoisomers of a compound are epimers of one another. In some examples, a 1-benzylisoquinoline alkaloid is converted to its epimer (e.g., epi-1-benzylisoquinoline alkaloid). The absolute stereochemistry is specified according to the Cahn-Ingold-Prelog R-S system. When a compound is a pure enantiomer, the stereochemistry at each chiral carbon can be specified by either R or S. Resolved compounds whose absolute configuration is unknown can be designated (+) or (−) depending on the direction (dextro- or levorotatory) in which they rotate plane polarized light at the wavelength of the sodium D line. Certain compounds described herein contain one or more asymmetric centers and can thus give rise to enantiomers, diastereomers, and other stereoisomeric forms that can be defined, in terms of absolute stereochemistry, as (R)- or (S)-.

TABLE 1

Example amino acid sequences of DRS-DRR enzymes, split DRS and DRR enzymes, and other nucleotide sequences.

| Sequence | Description | SEQ. ID NO. |
| --- | --- | --- |
| MELQYISYFQPTSSVVALLLALVSILSSVVVLRKTFLNNYSSSPASSTKTA VLSHQRQQSCALPISGLLHIFMNKNGLIHVTLGNMADKYGPIFSFPTGSH RTLVVSSWEMVKECFTGNNDTAFSNRPIPLAFKTIFYACGGIDSYGLSSV PYGKYWRELRKVCVHNLLSNQQLLKFRHLIISQVDTSFNKLYELCKNSE DNHGNYTTTTTTAAGMVRIDDWLAELSFNVIGRIVCGFQSGPKTGAPSR VEQFKEAINEASYFMSTSPVSDNVPMLGWIDQLTGLTRNMKHCGKKLD LVVESIINDHRQKRRFSRTKGGDEKDDEQDDFIDICLSIMEQPQLPGNNN PSQIPIKSIVLDMIGGGTDTTKLTTIWTLSLLLNNPHVLDKAKQEVDAHF RTKRRSTNDAAAAVVDFDDIRNLVYIQAIIKESMRLYPASPVVERLSGE DCVVGGFHVPAGTRLWANVWKMQRDPKVWDDPLVFRPDRFLSDEQK MVDVRGQNYELLPFGAGRRVCPGVSFSLDLMQLVLTRLILEFEMKSPSG KVDMTATPGLMSYKVIPLDILLTHRRIKPCVQSAASERDMESSGVPVITL GSGKVMPVLGMGTFEKVGKGSERERLAILKAIEVGYRYFDTAAAYETE EVLGEAIAEALQLGLVKSRDELFISSMLWCTDAHADRVLLALQNSLRNL KLEYVDLYMLPFPASLKPGKITMDIPEEDICRMDYRSVWAAMEECQNL GFTKSIGVSNFSCKKLQELMATANIPPAVNQVEMSPAFQQKKLREYCNA NNILVSAISVLGSNGTPWGSNAVLGSEVLKKIAMAKGKSVAQVSMRWV YEQGASLVVKSFSEERLRENLNIFDWELTKEDHEKIGEIPQCRILSAYFL VSPNGPFKSQEELWDDEA* | P. somniferum plant source; full-length amino acid sequence >RQNK-2062398 (also FPYZ-2037562, BMRX-2007040, and MLPX-2016197) | SEQ. ID NO. 1 |
| MELQYISYFQPTSSVVALLLALVSILSSVVVLRKTFLNNYSSSPASSTKTA VLSHQRQQSCALPISGLLHIFMNKNGLIHVTLGNMADKYGPIFSFPTGSH RTLVVSSWEMVKECFTGNNDTAFSNRPIPLAFKTIFYACGGIDSYGLSSV PYGKYWRELRKVCVHNLLSNQQLLKFRHLIISQVDTSFNKLYELCKNSE DNHGNYTTXLLLPQLAWRQPWKLYYXTTTTAAGMVRIDDWLAELSFN VIGRIVCGFQSGPKTGAPSRVEQFKEAINEASYFMSTSPVSDNVPMLGWI DQLTGLTRNMKHCGKKLDLVVESIINDHRQKRRFSRTKGGDEKDDEQD DFIDICLSIMEQPQLPGNNNPSQIPIKSIVLDMIGGGTDTTKLTTIWTLSLL LNNPHVLDKAKQEVDAHFRTKRRSTNDAAAAVVDFDDIRNLVYIQAII KESMRLYPASPVVERLSGEDCVVGGFHVPAGTRLWANVWKMQRDPK VWDDPLVFRPDRFLSDEQKMVDVRGQNYELLPFGAGRRVCPGVSFSLD LMQLVLTRLILEFEMKSPSGKVDMTATPGLMSYKVIPLDILLTHRRIKPC VQSAASERDMESSGVPVITLGSGKVMPVLGMGTFEKVGKGSERERLAIL KAIEVGYRYFDTAAAYETEEVLGEAIAEALQLGLVKSRDELFISSMLWC TDAHADRVLLALQNSLRNLKLEYVDLYMLPFPASLKPGKITMDIPEEDI CRMDYRSVWAAMEECQNLGFTKSIGVSNFSCKKLQELMATANIPPAVN | P. somniferum plant source; full-length amino acid sequence >KKCW-2026866, (also FPYZ-2037562, MLPX-2016197) | SEQ. ID NO. 2 |

TABLE 1-continued

Example amino acid sequences of DRS-DRR enzymes, split DRS and DRR enzymes, and other nucleotide sequences.

| Sequence | Description | SEQ. ID NO. |
|---|---|---|
| QVEMSPAFQQKKLREYCNANNILVSAISVLGSNGTPWGSNAVLGSEVL<br>KKIAMAKGKSVAQVSMRWVYEQGASLVVKSFSEERLRENLNIFDWELT<br>KEDHEKIGEIPQCRILSAYFLVSPNGPFKSQEELWDDEA* | | |
| MELQYISYFQPTSSVVALLLALVSILSSVVVLRKTFLNNYSSSPASSTKTA<br>VLSHQRQQSCALPISGLLHIFMNKNGLIHVTLGNMADKYGPIFSFPTGSH<br>RTLVVSSWEMVKECFTGNNDTAFSNRPIPLAFKTIFYACGGIDSYGLSSV<br>PYGKYWRELRKVCVHNLLSNQQLLKFRHLIISQVDTSFNKLYELCKNSE<br>DNHGNYTTTTTAAGMVRIDDWLAELSFNVIGRIVCGFQSGPKTGAPSR<br>VEQFKEAINEASYFMSTSPVSDNVPMLGWIDQLTGLTRNMKHCGKKLD<br>LVVESIINDHRQKRRFSRTKGGDEKDDEQDDFIDICLSIMEQPQLPGNNN<br>PSQIPIKSIVLDMIGGGTDTTKLTTIWTLSLLLNNPHVLDKAKQEVDAHF<br>RTKRRSTNDAAAAVVDFDDIRNLVYIQAIIKESMRLYPASPVVERLSGE<br>DCVVGGFHVPAGTRLWANVWKMQRDPKVWDDPLVFRPDRFLSDEQK<br>MVDVRGQNYELLPFGAGRRVCPGVSFSLDLMQLVLTRLILEFEMKSPSG<br>KVDMTATPGLMSYKVIPLDILLTHRRIKPCVQSAASERDMESSGVPVITL<br>GSGKVMPVLGMGTFEKVGKGSERERLAILKAIEVGYRYFDTAAAYETE<br>EVLGEAIAEALQLGLVKSRDELFISSMLWCTDAHADRVLLALQNSLRNL<br>KLEYVDLYMLPFPASLKPGKITMDIPEEDICRMDYRXVSKPWLH* | *P. somniferum* plant source; partial-length amino acid sequence >SUFP-2025636 | SEQ. ID NO. 3 |
| MRWHRXIDSYGLSSVPYGKYWRELRKVCVHNLLSNQQLLKFRHLIISQ<br>VDTSFNKLYELCKNSEDNQGNYPTTTTAAGMVRIDDWLAELSFNVIGRI<br>VCGFQSGPKTGAPSRVEQFKEAINEASYFMSTSPVSDNVPMLGWIDQLT<br>GLTRNMKHCGKKLDLVVESIINDHRQKRRFSRTKGGDEKDDEQDDFIDI<br>CLSIMEQPQLPGNNNPSQIPIKSIVLDMIGGGTDTTKLTTIWTLSLLLNNP<br>HVLDKAKQEVDAHFRTKRRSTNDAAAAVVDFDDIRNLVYIQAIIKESM<br>RLYPASPVVERLSGEDCVVGGFHVPAGTRLWANVWKMQRDPKVWDD<br>PLVFRPDRFLSDEQKMVDVRGQNYELLPFGAGRRVCPGVSFSLDLMQL<br>VLTRLILEFEMKSPSGKVDMTATPGLMSYKVIPLDILLTHRRIKPCVQSA<br>ASERDMESSGVPVITLGSGKVMPVLGMGTFEKVGKGSERERLAILKAIE<br>VGYRYFDTAAAYETEEVLGEAIAEALQLGLVKSRDELFISSMLWCTDA<br>HADRVLLALQNSLRNLKLEYVDLYMLPFPASLKPGKITMDIPEEDICRM<br>DYRSVWAAMEECQNLGFTKSIGVSNFSCKKLQELMATANIPPAVNQVE<br>MSPAFQQKKLREYCNANNILVSAISVLGSNGTPWGSNAVLGSEVLKKIA<br>MAKGKSVAQVSMRWVYEQGASLVVKSFSEERLRENLNIFDWELTKED<br>HEKIGEIPQCRILSAYFLVSPNGPFKSQEELWDDEA* | *P. somniferum* plant source; partial-length amino acid sequence >MIKW-2013651 | SEQ. ID NO. 4 |
| MELQYISYFQPTSSVVALLLALVSILSSVVVLRKTFLNNYSSSPASSTKTA<br>VLSHQRQQSCALPISGLLHIFMNKNGLIHVTLGNMADKYGPIFSFPTGSH<br>RTLVVSSWEMVKECFTGNNDTAFSNRPIPLAFKTIFYACGGIDSYGLSSV<br>PYGKYWRELRKVCVHNLLSNQQLLKFRHLIISQVDTSFNKLYELCKNSE<br>DNQGNYTTTTTAAGMVRIDDWLAELSFNVIGRIVCGFQSGPKTGAPSRV<br>EQFKEAINEASYFMSTSPVSDNVPMLGWIDQLTGLTRNMKHCGKKLDL<br>VVESIINDHRQKRRFSRTKGGDEKDDEQDDFIDICLSIMEQPQLPGNNNP<br>SQIPIKSIVLDMIGGGTDTTKLTTIWTLSLLLNNPHVLDKAKQEVDAHFR<br>TKRRSTNDAAAAVVDFDDIRNLVYIQAIIKESMRLYPASPVVERLSGED<br>CVVGGFHVPAGTRLWANVWKMQRDPKVWDDPLVFRPDRFLSDEQKM<br>VDVRGQNYELLPFGAGRRVCPGVSFSLDLMQLVLTRLILEFEMKSPSGK<br>VDMTATPGLMSYKVIPLDILLTHRRIKPCVQSAASERDMESSGVPVITLG<br>SGKVMPVLGMGTFEKVGKGSERERLAILKAIEVGYRYFDTAAAYETEE<br>VLGEAIAEALQLGLVKSRDELFISSMLWCTDAHADRVLLALQNSLRNL<br>KLEYVDLYMLPFPASLKPGKITMDIPEEDICRMDYRSVWAAMEECQNL<br>GFTKSIGVSNFSCKKLQELMATANIPPAVNQVEMSPAFQQKKLREYCNA<br>NNILVSAISVLGSNGTPWGSNAVLGSEVLKKIAMAKGKSVAQVSMRWV<br>YEQGASLVVKSFSEERLRENLNIFDWELTKEDHEKIGEIPQCRILSAYFL<br>VSPNGPFKSQEELWDDEA* | *P. setigerum* plant source; full-length amino acid sequence >EPRK-2027940 (also FPYZ-2037562, STDO-2019715, FNXH-2029312, MLPX-2016196, MLPX-2016197) | SEQ. ID No. 5 |
| MELQYISYFQPTSSVVALLLALVSILSSVVVLRKTFLNNYSSSPASSTKTA<br>VLSHQRQQSCALPISGLLHIFMNKNGLIHVTLGNMADKYGPIFSFPTGSH<br>RTLVVSSWEMVKECFTGNNDTAFSNRPIPLAFKTIFYACGGIDSYGLSSV<br>PYGKYWRELRKVCVHNLLSNQQLLKFRHLIISQVDTSFNKLYELCKNSE<br>DNQGNYTTTTTAAGMVRIDDWLAELSFNVIGRIVCGFQSGPKTGAPSRV<br>EQFKEAINEASYFMSTSPVSDNVPMLGWIDQLTGLTRNMKHCGKKLDL<br>VVESIINDHRQKRRFSRTKGGDEKDDEQDDFIDICLSIMEQPQLPGNNNP<br>SQIPIKSIVLDMIGGGTDTTKLTTIWTLSLLLNNPHVLDKAKQEVDAHFR<br>TKRRSTNDAAAAVVDFDDIRNLVYIQALYPASPVVERLSGEDCVVGGF<br>HVPAGTRLWANVWKMQRDPKVWDDPLVFRPDRFLSDEQKMVDVRGQ<br>NYELLPFGAGRRVCPGVSFSLDLMQLVLTRLILEFEMKSPSGKVDMTAT<br>PGLMSYKVIPLDILLTHRRIKPCVQSAASERDMESSGVPVITLGSGKVMP<br>VLGMGTFEKVGKGSERERLAILKAIEVGYRYFDTAAAYETEEVLGEAIA<br>EALQLGLVKSRDELFISSMLWCTDAHADRVLLALQNSLRNLKLEYVDL<br>YMLPFPASLKPGKITMDIPEEDICRMDYRSVWAAMEE | *P. setigerum* plant source; partial-length amino acid sequence >QCOU-2000833 | SEQ. ID NO. 6 |

TABLE 1-continued

Example amino acid sequences of DRS-DRR enzymes, split DRS and DRR enzymes, and other nucleotide sequences.

| Sequence | Description | SEQ. ID NO. |
|---|---|---|
| MELQYFSYFQPTSSVVALLLALVSILFSVVVLRKTFSNNYSSPASSTETA VLCHQRQQSCALPISGLLHVFMNKNGLIHVTLGNMADKYGPIFSFPTGS HRTLVVSSWEMVKECFTGNNDTAFSNRPIPLAFQTIFYACGGIDSYGLSS VPYGKYWRELRKVCVHNLLSNQQLLKFRHLIISQVDTSFNKLYELCKNS EDNQGMVRMDDWLAQLSFNVIGRIVCGFQSDPKTGAPSRVEQFKEVIN EASYFMSTSPVSDNVPMLGWIDQLTGLTRNMKHCGKKLDLVVESIIKD HRQKRRFSRTKGGDEKDDEQDDFIDICLSIMEQPQLPGNNSPPQIPIKSIV LDMIGGGTDTTKLTTIWTLSLLLNNPHVLDKAKQEVDAHFRKKRRSTD DAAAAVVDFDDIRNLVYIQAIIKESMRLYPASPVVERLSGEDCVVGGFH VPAGTRLWANVWKMQRDPKVWDDPLVFRPERFLSDEQKMVDVRGQN YELLPFGAGRRICPGVSFSLDLMQLVLTRLILEFEMKSPSGKVDMTATPG LMSYKVVPLDILLTHRRIKSCVQLASSERDMESSGVPVITLSSGKVMPVL GMGTFEKVGKGSERERLAILKAIEVGYRYFDTAAAYETEEVLGEAIAEA LQLGLIESRDELFISSMLWCTDAHPDRVLLALQNSLRNLKLEYLDLYML PFPASLKPGKITMDIPEEDICRMDYRSVWSAMEECQNLGFTKSIGVSNFS SKKLQELMATANIPPAVNQVEMSPAFQQKKLREYCNANNILVSAVSILG SNGTPWGSNAVLGSEVLKQIAMAKGKSVAQVSMRWVYEQGASLVVK SFSEERLRENLNIFDWELTKEDNEKIGEIPQCRILTAYFLVSPNGPFKSQE ELWDDKA* | *P. bracteatum* plant source; full-length amino acid sequence >SSDU-2015634 (also SSDU-2015636, ZSNV-2027701, RRID-2004435) | SEQ. ID NO. 7 |
| MELQYFSYFQPTSSVVALLLALVSILFSVVVLRKTFSNNYSSPASSTETA VLCHQRQQSCALPISGLLHVFMNKNGLIHVTLGNMADKYGPIFSFPTGS HRTLVVSSWEMVKECFTGNNDTAFSNRPIPLAFQTIFYACGGIDSYGLSS VPYGKYWRELRKVCVHNLLSNQQLLKFRHLIISQVDTSFNKLYELCKNS EDNQGMVRMDDWLAQLSFNVIGRIVCGFQSDPKTGAPSRVEQFKEVIN EASYFMSTSPVSDNVPMLGWIDQLTGLTRNMKHCGKKLDLVVESIIKD HRQKRRFSRTKGGDEKDDEQDDFIDICLSIMEQPQLPGNNSPPQIPIKSIV LDMIGGGTDTTKLTTIWTLSLLLNNPHVLDKAKQEVDAHFRKKRRSTD DAAAAVVDFDDIRNLVYIQAIIKESMRLYPASPVVERLSGEDCVVGGFH VPAGTRLWANVWKMQRDPKVWDDPLVFRPERFLSDEQKMVDVRGQN YELLPFGAGRRICPGVSFSLDLMQLVLTRLILEFEMKSPSGKVDMTATPG LMSYKVVPLDILLTHRRIKSCVQLASSERDMESSGVPVITLSSGKVMPVL GMGTFEKVGKGSERERLAILKAIEVGYRYFDTAAAYETEEVLGEAIAEA LQLGLIESRDELFISSMLWCTDAHPDRVLLALQNSLRNLKLEYLDLYML PFPASLKPGKITMDIPEEDICRMDYRSVWSAMEECQNLGFTKSIGVSNFS CKKLQELMATANIPPAVNQVEMSPAFQQKKLREYCNANNILVSAVSILG SNGTPWGSNAVLGSEVLKQIAMAKGKSVAQVSMRWVYEQGASLVVK SFSEERLRENLNIFDWELTKEDNEKIGEIPQCRILTAYFLVSPNGPFKSQE ELWDDKA* | *P. bracteatum* plant source; full-length amino acid sequence >TMWO-2027322 (also RRID-2004435) | SEQ. ID NO. 8 |
| SSPASSTETAVLCHQRQQSCALPISGLLHIFMNKNGLIHVTLGNMADKY GPIFSFPTGSHRILVVSSWEMVKECFTGNNDTAFSNRPIPLAFKTIFYACR GIDSYGLSSVPYGKYWRELRKVCVHNLLSNQQLLKFRHLIISQVDTSFN KLYELCKNSEDNQGMVRMDDWLAQLSFSVIGRIVCGFQSDPKTGAPSR VEQFKEAINEASYFMSTSPVSDNVPMLGWIDQLTGLTRNMTHCGKKLD LVVESIINDHRQKRRFSRTKGGDEKDDEQDDFIDICLSIMEQPQLPGNNN PPKIPIKSIVLDMIGAGTDTTKLTIIWTLSLLLNNPNVLAKAKQEVDAHFE TKKRSTNEASVVVDFDDLNLVYIQAIIKESMRLYPSPVVERLSSEDCV VGGFHVPAGTRLWANVWKMQRDPKVWDDPLVFRPERFLSDEQKMVD VRGQNYELLPFGAGRRICPGVSFSLDLMQLVLTRLILEFEMKSPSGKVD MTATPGLMSYKVVPLDILLTHRRIKSCVQLASSERDMESSGVPVITLRSG KVMPVLGMGTFEKAGKGSERERLAILKAIEVGYRYFDTAAAYETEEVL GEAIAEALQLGLIKSRDELFISSMLWCTDAHPDRVLLALQNSLRNLKLE YVDLYMLPFPASLKPGKITMDIPEEDICPMDYRSVWSAMEECQNLGLTK SIGVSNFSCKKLEELMATANIPPAVNQVEMSPAFQQKKLREYCNANNIL VSAVSILGSNGTPWGSNAVLGSEVLKKIAMAKGKSVAQVSMRWVYEQ GASLVVKSFSEERLRENLNIFDWQLTKEDNEKIGEIPQCRILSAYFLVSPK GPFKSQEELWDDKA* | *P. bracteatum* plant source; partial-length amino acid sequence >pbr.PBRS T1PF_89405 | SEQ. ID No. 9 |
| SSPASSTETAVLCHQRQQSCALPISGLLHIFMNKNGLIHVTLGNMADKY GPIFSFPTGSHRILVVSSWEMVKECFTGNNDTFFSNRPIPLAFKIIFYAGG VDSYGLALVPYGKYWRELRKICVHNLLSNQQLLKFRHLIISQVDTSFNK LYELCKNSEDNQGMVRMDDWLAQLSFSVIGRIVCGFQSDPKTGAPSRV EQFKEAINEASYFMSTSPVSDNVPMLGWIDQLTGLTRNMTHCGKKLDL VVESIINDHRQKRRFSRTKGGDEKDDEQDDFIDICLSIMEQPQLPGNNNP PKIPIKSIVLDMIGGGTDTTKLTTIWTLSLLLNNPHVLDKAKQEVDAHFL TKKRSTNDAAVVDFDDIRNLVYIQAIIKESMRLYPASPVVERLSGEDCV VGGFHVPAGTRLWVNVWKMQRDPNVWADPMVFRPERFLSHGQKKM VDVRGKNYELLPFGAGRRICPGISFSLDLMQLVLTRLILEFEMKSPSGKV DMTATPGLMSYKVVPLDILLTHRRIKSCVQLASSERDMESSGVPVITLRS GKVMPVLGMGTFEKAGKGSERERLAILKAIEVGYRYFDTAAAYETEEV LGEAIAEALQLGLIKSRDELFISSMLWCTDAHPDRVLLALQNSLRNLKLE YVDLYMLPFPASLKPGKITMDIPEEDICPMDYRSVWSAMEECQNLGLTK SIGVSNFSCKKLEELMATANIPPAVNQVEMSPAFQQKKLREYCNANNIL | *P. bracteatum* plant source; partial-length amino acid sequence >pbr.PBRS T1PF_4328 | SEQ. ID NO. 10 |

TABLE 1-continued

Example amino acid sequences of DRS-DRR enzymes, split DRS and DRR enzymes, and other nucleotide sequences.

| Sequence | Description | SEQ. ID NO. |
|---|---|---|
| VSAVSILGSNGTPWGSNAVLGSEVLKKIAMAKGKSVAQVSMRWVYEQ GASLVVKSFSEERLRENLNIFDWQLTKEDNEKIGEIPQCRILSAYFLVSPK GPFKSQEELWDDKA* | | |
| SSPASSTETAVLCHQRQQSCALPISGLLHIFMNKNGLIHVTLGNMADKY GPIFSFPTGSHRILVVSSWEMVKECFTGNNDTFFSNRPIPLAFKIIFYAGG VDSYGLALVPYGKYWRELRKICVHNLLSNQQLLNFRHLIISQVDTSFNK LYDLSNKKKNTTTDSGTVRMDDWLAQLSFNVIGRIVCGFQTHTETSATS SVERFTEAIDEASRFMSIATVSDTFPWLGWIDQLTGLTRKMKHYGKKLD LVVESIIEDHRQNRRISGTKQGDDFIDICLSIMEQPQIIPGNNDPPRQIPIKS IVLDMIGGGTDTTKLTTTWTLSLLLNNPHVLEKAREEVDAHFGTKRRPT NDDAVMVEFDDIRNLVYIQAIIKESMRLYPASPVVERLSGEDCVVGGFH VPAGTRLWVNVWKMQRDPNVWADPMVFRPERFLSDEQKMVDRGQ NYELLPFGAGRRICPGVSFSLDLMQLVLTRLILEFEMKSPSGKVDMTATP GLMSYKVVPLDILLTHRRIKSCVQLASSERDMESSGVPVITLRSGKVMP VLGMGTFEKAGKGSERERLAILKAIEVGYRYFDTAAAYETEEVLGEAIA EALQLGLIKSRDELFISSMLWCTDAHPDRVLLALQNSLRNLKLEYVDLY MLPFPASLKPGKITMDIPEEDICPMDYRSVWSAMEECQNLGLTKSIGVS NFSCKKLEELMATANIPPAVNQVEMSPAFQQKKLREYCNANNILVSAV SILGSNGTPWGSNAVLGSEVLKKIAMAKGKSVAQVSMRWVYEQGASL VVKSFSEERLRENLNIFDWQLTKEDNEKIGEIPQCRILSAYFLVSPKGPFK SQEELWDDKA* | *P. bracteatum* plant source; partial-length amino acid sequence >pbr.PBRS T1PF_12180 | SEQ. ID NO. 11 |
| VALRKKILKNYYSSSSTATAVSHQWPKASRALPLIDLLHVFFNKTDLM HVTLGNMADKFGPIFSFPTGSHRTLVVSSWEKAKECFTGNNDIVFSGRP LPLAFKLIFYAGGIDSYGISQVPYGKKWRELRNICVHNILSNQQLLKFRH LMISQVDNSFNKLYEVCNSNKDEGDSATSTTAAGIVRMDDWLGKLAPD VIARIVCGFQSQTETSTTSSMERFTEAMDEASRFMSVTAVSDTVPWLGW IDQLTGLKRNMKHCGKKLNLVVKSIIEDHRQKRRLSSTKKGDENIIDED EQDDFIDICLSIMEQPQLPGNNNPPKIPIKSIVLDMIGGGTDTTKLTTIWTL SLLLNNPHVLDKAKQEVDAHFLTKRRSTNDAAVVDFDDIRNLVYIQAII KESMRLYPASPVVERLSGEDCVVGGFHVPAGTRLWVNVWKMQRDPN VWADPMVFRPERFLSDEQKMVDRGQNYELLPFGAGRRICPGVSFSLD LMQLVLTRLILEFEMKSPSGKVDMTATPGLMSYKVVPLDILLTHRRIKS CVQLASSERDMESSGVPVITLRSGKVMPVLGMGTFEKAGKGSERERLAI LKAIEVGYRYFDTAAAYETEEVLGEAIAEALQLGLIKSRDELFISSMLWC TDAHPDRVLLALQNSLRNLKLEYVDLYMLPFPASLKPGKITMDIPEEDIC PMDYRSVWSAMEECQNLGLTKSIGVSNFSCKKLEELMATANIPPAVNQ VEMSPAFQQKKLREYCNANNILVSAVSILGSNGTPWGSNAVLGSEVLK KIAMAKGKSVAQVSMRWVYEQGASLVVKSFSEERLRENLNIFDWQLT KEDNEKIGEIPQCRILSAYFLVSPKGPFKSQEELWDDKA* | *P. bracteatum* plant source; partial-length amino acid sequence >pbr.PBRS T1PF_4329 | SEQ. ID NO. 12 |
| MELQYFSYFQPTSSVVALLLALVSILFSVVVLRKTFSNNYSSPASSTETA VLCHQRQQSCALPISGLLHVFMNKNGLIHVTLGNMADKYGPIFSFPTGS HRTLVVSSWEMVKECFTGNNDTAFSNRPIPLAFQTIFYACGGIDSYGLSS VPYGKYWRELRKVCVHNLLSNQQLLKFRHLIISQVDTSFNKLYELCKNS EDNQGMVRMDDWLAQLSFNVIGRIVCGFQSDPKTGAPSRVEQFKEVIN EASYFMSTSPVSDNVPMLGWIDQLTGLTRNMKHCGKKLDLVVESIIKD HRQKRRFSRTKGGDEKDDEQDDFIDICLSIMEQPQLPGNNSPPQIPIKSIV LDMIGGGTDTTKLTTIWTLSLLLNNPHVLDKAKQEVDAHFRKKRRSTD DAAAAVVDFDDIRNLVYIQAIIKESMRLYPASPVVERLSGEDCVVGGFH VPAGTRLWANVWKMQRDPKVWDDPLVFRPERFLSDEQKMVDRGQN YELLPFGAGRRICPGVSFSLDLMQLVLTRLILEFEMKSPSGKVDMTATPG LMSYKVVPLDILLTHRRIKSCVQLASSERDMESSGVPVITLSSGKVMPVL GMGTFEKVGKGSERERLAILKAIEVGYRYFDTAAAYETEEVLGEAIAEA LQLGLIESRDELFISSMLWCTDAHPDRVLLALQNSLRNLKLEYLDLYML PFPASLKPGKITMDIPEEDICRMDYRSVWSAMEECQNLGFTKSIGVSNFS SKKLQELMATANIPPAVNQVEMSPAFQQKKLREYCNANNILVSAVSILG SNGTPWGSNAVLGSEVLKQIAMAKGKSVAQVSMRWVXKFSAYAIVWS LFFGHRICITLYSFLIRNVAYICITY* | *P. bracteatum* plant source; partial-length amino acid sequence >SSDU-2015635 | SEQ. ID NO. 13 |
| MELQYFSYFQPTSSVVALLLALVSILFSVVVLRKTFSNNYSSPASSTETA VLCHQRQQSCALPISGLLHVFMNKNGLIHVTLGNMADKYGPIFSFPTGS HRTLVVSSWEMVKECFTGNNDTAFSNRPIPLAFQTIFYACGGIDSYGLSS VPYGKYWRELRKVCVHNLLSNQQLLKFRHLIISQVDTSFNKLYELCKNS EDNQGMVRMDDWLAQLSFNVIGRIVCGFQSDPKTGAPSRVEQFKEVIN EASYFMSTSPVSDNVPMLGWIDQLTGLTRNMKHCGKKLDLVVESIIKD HRQKRRFSRTKGGDEKDDEQDDFIDICLSIMEQPQLPGNNSPPQIPIKSIV LDMIGGGTDTTKLTTIWTLSLLLNNPHVLDKAKQEVDAHFRKKRRSTD DAAAAVVDFDDIRNLVYIQAIIKESMRLYPASPVVERLSGEDCVVGGFH VPAGTRLWANVWKMQRDPKVWDDPLVFRPERFLSDEQKMVDRGQN YELLPFGAGRRICPGVSFSLDLMQLVLTRLILEFEMKSPSGKVDMTATPG LMSYKVVPLDILLTHRRIKSCVQLASSERDMESSGVPVITLSSGKVMPVL GMGTFEKVGKGSERERLAILKAIEVGYRYFDTAAAYETEEVLGEAIAEA | *P. bracteatum* plant source; partial-length amino acid sequence >SSDU-2015637 | SEQ. ID NO. 14 |

TABLE 1-continued

Example amino acid sequences of DRS-DRR enzymes, split DRS and DRR enzymes, and other nucleotide sequences.

| Sequence | Description | SEQ. ID NO. |
|---|---|---|
| LQLGLIESRDELFISSMLWCTDAHPDRVLLALQNSLRQVFLMQIRLIYIC<br>TYQQVHLNIYFQINEFVLCDMYRNLKLEY | | |
| LNNYSSSPASSTKTAVLSHQRQQSCALPISGLLHIFMNKNGLIHVTLGNM<br>ADKYGPIFSFPTGSHRTLVVSSWEMVKECFTGNNDTAFSNRPIPLAFKTI<br>FYACGGIDSYGLSSVPYGKYWRELRKVCVHNLLSNQQLLKFRHLIISQV<br>DTSFNKLYELCKNSEDNQGNYPTTTTAAGMVRIDDWLAELSFNVIGRIV<br>CGFQSGPKTGAPSRVEQFKEAINEASYFMSTSPVSDNVPMLGWIDQLTG<br>LTRNMKHCGKKLDLVVESIINDHRQKRRFSRTKGGDEKDDEQDDFIDIC<br>LSIMEQPQLPGNNNPSQIPIKSIVLDMIGGGTDTTKLTTIWTLSLLLNNPH<br>VLDKAKQEVDAHFRTKRRSTNDAAAAVVDFDDIRNLVYIQAIIKESMR<br>LYPASPVVERLSGEDCVVGGFHVPAGTRLWANVWKMQRDPKVWDDP<br>LVFRPDRFLSDEQKMVDVRGQNYELLPFGAGRRVCPGVSFSLDLMQLV<br>LTRLILEFEMKSPSGKVDMTATPGLMSYKVIPLDILLTHRRIKPCVQSAA<br>SERDMESSGVPVITLGSGKVMPVLGMGTFEKVGKGSERERLAFLKAIEV<br>GYRYFDTAAAYETEEFLGEAIAEALQLGLIKSRDELFITSKLWPCDAHPD<br>LVVPALQNSLRNLKLEYVDLYMLPFPASLKPGKITMDIPEEDICRMDYR<br>SVWAAMEECQNLGFTKSIGVSNFSCKKLQELMATANIPPAVNQVEMSP<br>AFQQKKLREYCNANNILVSAISVLGSNGTPWGSNAVLGSEVLKKIAMA<br>KGKSVAQVSMRWVYEQGASLVVKSFSEERLRENLNIFDWELTKEDHEK<br>IGEIPQCRILSAYFLVSPNGPFKSQEELWDDEA* | C. majus plant source; partial-length amino acid sequence >chm.CMAST2PF_14984 | SEQ. ID NO. 15 |
| MELQYFSYFQPTSSVVALLLALVSILFSVVVLRKTFSNNYSSPASSTETA<br>VLCHQRQQSCALPISGLLHVFMNKNGLIHVTLGNMADKYGPIFSFPTGS<br>HRTLVVSSWEMVKECFTGNNDTAFSNRPIPLAFQTIFYACGGIDSYGLSS<br>VPYGKYWRELRKVCVHNLLSNQQLLKFRHLIISQVDTSFNKLYELCKNS<br>EDNQGMVRMDDWLAQLSFNVIGRIVCGFQSDPKTGAPSRVEQFKEVIN<br>EASYFMSTSPVSDNVPMLGWIDQLTGLTRNMKHCGKKLDLVVESIIKD<br>HRQKRRFSRTKGGDEKDDEQDDFIDICLSIMEQPQLPGNNSPPQIPIKSIV<br>LDMIGGGTDTTKLTTIWTLSLLLNNPHVLDKAKQEVDAHFRKKRRSTD<br>DAAAAVVDFDDIRNLVYIQAIIKESMRLYPASPVVERLSGEDCVVGGFH<br>VPAGTRLWANVWKMQRDPKVWDDPLVFRPERFLSDEQKMVDVRGQN<br>YELLPFGAGRRICPGVSFSLDLMQLVLTRLILEFEMKSPSGKVDMTATPG<br>LMSYKVVPLDILLTHRRIKSCVQLASSERDMESSGVPVITLSSGKVMPVL<br>GMGTFEKVGKGSERERLAILKAIEVGYRYFDTAAAYETEEVLGEAIAEA<br>LQLGLIESRDELFISSMLWCTDAHPDRVLLALQNSLRNLKLEYLDLYML<br>PFPASLKPGKITMDIPEEDICRMDYRSVWSAMEECQNLGFTKSIGVSNFS<br>CKKLQELMATANIPPAVNQVEMSPAFQQKKLREYCNANNILVSAVSILG<br>SNGTPWGSNAVLGSEVLKQIAMAKGKSVAQVSMRWVYEQGASLVVK<br>SFSEERLRENLNIFDWELTKEDNEKIGEIPQCRILTAYFLVSPNGPFKSQE<br>ELWDDKA* | P. bracteatum DRS-DRR | SEQ. ID NO. 16 |
| MELQYFSYFQPTSSVVALLLALVSILFSVVVLRKTFSNNYSSPASSTETA<br>VLCHQRQQSCALPISGLLHVFMNKNGLIHVTLGNMADKYGPIFSFPTGS<br>HRTLVVSSWEMVKECFTGNNDTAFSNRPIPLAFQTIFYACGGIDSYGLSS<br>VPYGKYWRELRKVCVHNLLSNQQLLKFRHLIISQVDTSFNKLYELCKNS<br>EDNQGMVRMDDWLAQLSFNVIGRIVCGFQSDPKTGAPSRVEQFKEVIN<br>EASYFMSTSPVSDNVPMLGWIDQLTGLTRNMKHCGKKLDLVVESIIKD<br>HRQKRRFSRTKGGDEKDDEQDDFIDICLSIMEQPQLPGNNSPPQIPIKSIV<br>LDMIGGGTDTTKLTTIWTLSLLLNNPHVLDKAKQEVDAHFRKKRRSTD<br>DAAAAVVDFDDIRNLVYIQAIIKESMRLYPASPVVERLSGEDCVVGGFH<br>VPAGTRLWANVWKMQRDPKVWDDPLVFRPERFLSDEQKMVDVRGQN<br>YELLPFGAGRRICPGVSFSLDLMQLVLTRLILEFEMKSPSGKVDMTATPG<br>LMSYKVVPLDILLTHRRIKSCVQLASSERD | P. bracteatum DRS | SEQ. ID NO. 17 |
| MESSGVPVITLSSGKVMPVLGMGTFEKVGKGSERERLAILKAIEVGYRY<br>FDTAAAYETEEVLGEAIAEALQLGLIESRDELFISSMLWCTDAHPDRVLL<br>ALQNSLRNLKLEYLDLYMLPFPASLKPGKITMDIPEEDICRMDYRSVWS<br>AMEECQNLGFTKSIGVSNFSCKKLQELMATANIPPAVNQVEMSPAFQQ<br>KKLREYCNANNILVSAVSILGSNGTPWGSNAVLGSEVLKQIAMAKGKS<br>VAQVSMRWVYEQGASLVVKSFSEERLRENLNIFDWELTKEDNEKIGEIP<br>QCRILTAYFLVSPNGPFKSQEELWDDKA* | P. bracteatum DRR | SEQ. ID NO. 18 |
| TTCAGTTCGAGTTTATCATTATCAATACTGCCATTTCAAAGAATACGT<br>AAATAATTAATAGTAGTGATTTTCCTAACTTTATTTAGTCAAAAAATT<br>AGCCTTTTAATTCTGCTGTAACCCGTACATGCCCAAAATAGGGGGCG<br>GGTTACACAGAATATATAACATCGTAGGTGTCTGGGTGAACAGTTTA<br>TTCCTGGCATCCACTAAATATAATGGAGCCCGCTTTTTAAGCTGGCA<br>TCCAGAAAAAAAAGAATCCCAGCACCAAAATATTGTTTTCTTCACC<br>AACCATCAGTTCATAGGTCCATTCTCTTAGCGCAACTACAGAGAACA<br>GGGGCACAAACAGGCAAAAACGGGCACAACCTCAATGGAGTGATG<br>CAACCTGCCTGGAGTAAATGATGACACAAGGCAATTGACCCACGCA<br>TGTATCTATCTCATTTTCTTACACCTTCTATTACCTTCTGCTCTCTG<br>ATTTGGAAAAGCTGAAAAAAAGGTTGAAACCAGTTCCCTGAAAT | TDH3 Promoter | SEQ. ID NO. 19 |

TABLE 1-continued

Example amino acid sequences of DRS-DRR enzymes, split DRS and DRR enzymes, and other nucleotide sequences.

| Sequence | Description | SEQ. ID NO. |
|---|---|---|
| TATTCCCCTACTTGACTAATAAGTATATAAAGACGGTAGGTATTGAT<br>TGTAATTCTGTAAATCTATTTCTTAAACTTCTTAAATTCTACTTTTATA<br>GTTAGTCTTTTTTTTAGTTTTAAAACACCAAGAACTTAGTTTCGAATA<br>AACACACATAAACAAACAAA | | |
| GAGCGTTGGTTGGTGGATCAAGCCCACGCGTAGGCAATCCTCGAGC<br>AGATCCGCCAGGCGTGTATATATAGCGTGGATGGCCAGGCAACTTTA<br>GTGCTGACACATACAGGCATATATATATGTGTGCGACGACACATGAT<br>CATATGGCATGCATGTGCTCTGTATGTATATAAAACTCTTGTTTTCTT<br>CTTTTCTCTAAATATTCTTTCCTTATACATTAGGACCTTTGCAGCATA<br>AATTACTATACTTCTATAGACACACAAACACAAATACACACACTAAA<br>TTAATA | CYC1<br>Promoter | SEQ. ID<br>NO. 20 |
| CATAGCTTCAAAATGTTTCTACTCCTTTTTTACTCTTCCAGATTTTCTC<br>GGACTCCGCGCATCGCCGTACCACTTCAAAACACCCAAGCACAGCAT<br>ACTAAATTTCCCCTCTTTCTTCCTCTAGGGTGTCGTTAATTACCCGTA<br>CTAAAGGTTTGGAAAGAAAAAAGAGACCGCCTCGTTTCTTTTTCTT<br>CGTCGAAAAAGGCAATAAAAATTTTTATCACGTTTCTTTTTCTTGAA<br>AATTTTTTTTTGATTTTTTTCTCTTTCGATGACCTCCCATTGATATT<br>TAAGTTAATAAACGGTCTTCAATTTCTCAAGTTTCAGTTTCATTTTTC<br>TTGTTCTATTACAACTTTTTTTACTCTTGCTCATTAGAAAGAAAGCA<br>TAGCAATCTAATCTAAGTTTTAATTACAAA | TEF1<br>Promoter | SEQ. ID<br>NO. 21 |
| ACAGGCCCCTTTTCCTTTGTCGATATCATGTAATTAGTTATGTCACGC<br>TTACATTCACGCCCTCCTCCCACATCGCTCTAACCGAAAAGGAAGG<br>AGTTAGACAACCTGAAGTCTAGGTCCCTATTTATTTTTTTAATAGTT<br>ATGTTAGTATTAAGAACGTTATTTATATTTCAAATTTTTCTTTTTTTC<br>TGTACAAACGCGTGTACGCATGTAACATTATACTGAAAACCTTGCTT<br>GAGAAGGTTTTGGGACGCTCGAAGGCTTTAATTTG | CYC1<br>Terminator | SEQ. ID<br>NO. 22 |
| GCGAATTTCTTATGATTTATGATTTTTATTATTAAATAAGTTATAAAA<br>AAAATAAGTGTATACAAATTTTAAAGTGACTCTTAGGTTTTAAAACG<br>AAAATTCTTATTCTTGAGTAACTCTTTCCTGTAGGTCAGGTTGCTTTC<br>TCAGGTA | ADH1<br>Terminator | SEQ. ID<br>NO. 23 |
| CCTCGCCGCAGTTAATTAAAGTCAGTGAGCGAGGAAGCGCGTAACT<br>ATAACGGTCCTAAGGTAGCGAATCCTGATGCGGTATTTTCTCCTTAC<br>GCATCTGTGCGGTATTTCACACCGCATAGATCGGCAAGTGCACAAAC<br>AATACTTAAATAAATACTACTCAGTAATAACCTATTTCTTAGCATTTT<br>TGACGAAATTTGCTATTTTGTTAGAGTCTTTTACACCATTTGTCTCCA<br>CACCTCCGCTTACATCAACACCAATAACGCCATTTAATCTAAGCGCA<br>TCACCAACATTTTCTGGCGTCAGTCCACCAGCTAACATAAAATGTAA<br>GCTTTCGGGGCTCTCTTGCCTTCCAACCCAGTCAGAAATCGAGTTCC<br>AATCCAAAAGTTCACCTGTCCCACCTGCTTCTGAATCAAACAAGGGA<br>ATAAACGAATGAGGTTTCTGTGAAGCTGCACTGAGTAGTATGTTGCA<br>GTCTTTTGGAAATACGAGTCTTTTAATAACTGGCAAACCGAGGAACT<br>CTTGGTATTCTTGCCACGACTCATCTCCATGCAGTTGGACGATATCA<br>ATGCCGTAATCATTGACCAGAGCCAAAACATCCTCCTTAAGTTGATT<br>ACGAAACACGCCAACCAAGTATTTCGGAGTGCCTGAACTATTTTTAT<br>ATGCTTTTACAAGACTTGAAATTTTCCTTGCAATAACCGGGTCAATT<br>GTTCTCTTTCTATTGGGCACACATATAATACCCAGCAAGTCAGCATC<br>GGAATCTAGAGCACATTCTGCGGCCTCTGTGCTCTGCAAGCCGCAAA<br>CTTTCACCAATGGACCAGAACTACCTGTGAAATTAATAACAGACATA<br>CTCCAAGCTGCCTTTGTGTGCTTAATCACGTATACTCACGTGCTCAAT<br>AGTCACCAATGCCCTCCCTCTTGGCCCTCTCCTTTTCTTTTTTCGACC<br>GAATTAATTCTTAATCGGCAAAAAAAGAAAAGCTCCGGATCAAGAT<br>TGTACGTAAGGTGACAAGCTATTTTTCAATAAAGAATATCTTCCACT<br>ACTGCCATCTGGCGTCATAACTGCAAAGTACACATATATTACGATGC<br>TGTTCTATTAAATGCTTCCTATATTATATATATAGTAATGTCGTGATC<br>TATGGTGCACTCTCAGTACAATCTGCTCTGATGCCGCATAGTTAAGC<br>CAGCCCCGACACCCGCCAACACCCGCTGACGCGCCCTGACGGGCTTG<br>TCTGCTCCCGGCATCCGCTTACAGACAAGCTGTGACCGTCTCCGGGA<br>GCTGCATGTGTCAGAGGTTTTCACCGTCATCACCGAAACGCGCGAGA<br>CGAAAGGGCCTCGTGATACGCCTATTTTTATAGGTTAATGTCATGAT<br>AATAATGGTTCTTAGACGGATCGCTTGCCTGTAACTTACACGCGCC<br>TCGTATCTTTTAATGATGGAATAATTTGGGAATTTACTCTGTGTTTAT<br>TTATTTTTATGTTTTGTATTTGGATTTTAGAAAGTAAATAAAGAAGGT<br>AGAAGAGTTACGGAATGAAGAAAAAAAATAAACAAAGGTTTAAA<br>AAATTTCAACAAAAAGCGTACTTTACATATATATTTATTAGACAAGA<br>AAAGCAGATTAAATAGATATACATTCGATTAACGATAAGTAAAATG<br>TAAAATCACAGGATTTTCGTGTGTGGTCTTCTACACAGACAAGGTGA<br>AACAATTCGGCATTAATACCTGAGAGCAGGAAGAGCAAGATAAAAG<br>GTAGTATTTGTTGGCGATCCCCCTAGAGTCTTTTACATCTTCGGAAAA<br>CAAAAACTATTTYTTCTTTAATTTCTTTTTTTACTTTCTATTTTTAATTT | pDW10 | SEQ. ID<br>NO. 24 |

TABLE 1-continued

Example amino acid sequences of DRS-DRR enzymes, split DRS and DRR enzymes, and other nucleotide sequences.

| Sequence | Description | SEQ. ID NO. |
|---|---|---|
| ATATATTTATATTAAAAAATTTAAATTATAATTATTTTTATAGCACGT<br>GATGAAAAGGACCCAGGTGGCACTTTTCGGGGAAATGTGCGCGGAA<br>CCCCTATTTGTTTATTTTTCTAAATACATTCAAATATGTATCCGCTCA<br>TGAGACAATAACCCTGATAAATGCTTCAATAATATTGAAAAGGAA<br>GAGTATGAGTATTCAACATTTCCGTGTCGCCCTTATTCCCTTTTTTGC<br>GGCATTTTGCCTTCCTGTTTTTGCTCACCCAGAAACGCTGGTGAAAGT<br>AAAAGATGCTGAAGATCAGTTGGGACGCGTAGTCTAGACCAGCCAG<br>GACAGAAATGCCTCGACTTCGCTGCTACCCAAGGTTGCCGGGTGACG<br>CACACCGTGGAAACGGATGAAGGCACGAACCCAGTGGACATAAGCC<br>TGTTCGGTTCGTAAGCTGTAATGCAAGTAGCGTATGCGCTCACGCAA<br>CTGGTCCAGAACCTTGACCGAACGCAGCGGTGGTAACGGCGCAGTG<br>GCGGTTTTCATGGCTTGTTATGACTGTTTTTTTGGGGTACAGTCTATG<br>CCTCGGGCATCCAAGCAGCAAGCGCGTTACGCCGTGGGTCGATGTTT<br>GATGTTATGGAGCAGCAACGATGTTACGCAGCAGGGCAGTCGCCCT<br>AAAACAAAGTTAAACATTATGAGGGAAGCGGTGATCGCCGAAGTAT<br>CGACTCAACTATCAGAGGTAGTTGGCGCCATCGAGCGCCATCTCGAA<br>CCGACGTTGCTGGCCGTACATTTGTACGGCTCCGCAGTGGATGGCGG<br>CCTGAAGCCACACAGTGATATTGATTTGCTGGTTACGGTGACCGTAA<br>GGCTTGATGAAACAACGCGGCGAGCTTTGATCAACGACCTTTTGGAA<br>ACTTCGGCTTCCCCTGGAGAGAGCGAGATTCTCCGCGCTGTAGAAGT<br>CACCCATTGTTGTGCACGACGACATCATTCCGTGGCGTTATCCAGCTA<br>AGCGCGAACTGCAATTTGGAGAATGGCAGCGCAATGACATTCTTGC<br>AGGTATCTTCGAGCCAGCCACGATCGACATTGATCTGGCTATCTTGC<br>TGACAAAAGCAAGAGAACATAGCGTTGCCTTGGTAGGTCCAGCGGC<br>GGAGGAACTCTTTGATCCGGTTCCTGAACAGGATCTATTTGAGGCGC<br>TAAATGAAACCTTAACGCTATGGAACTCGCCGCCCGACTGGGCTGGC<br>GATGAGCGAAATGTAGTGCTTACGTTGTCCCGCATTTGGTACAGCGC<br>AGTAACCGGCAAAATCGCGCCGAAGGATGTCGCTGCCGGCTGGGCA<br>ATGGAGCGCTGCCGGCCCAGTATCAGCCCGTCATACTTGAAGCTAG<br>ACAGGCTTATCTTGGACAAGAAGAAGATCGCTTGGCCTCGCGCGCA<br>GATCAGTTGGAAGAATTTGTCCACTACGTGAAAGGCGAGATCACCA<br>AGGTAGTCGGCAAATAACCCTCGAGCATTCAAGGCGCCTTGATTATT<br>TGACGTGGTTTGATGGCCTCCACGCACGTTGTGATATGTAGATGATT<br>CAGTTCGAGTTTATCATTATCAATACTGCCATTTCAAAGAATACGTA<br>AATAATTAATAGTAGTGATTTTCCTAACTTTATTTAGTCAAAAAATTA<br>GCCTTTTAATTCTGCTGTAACCCGTACATGCCCAAAATAGGGGCGG<br>GTTACACAGAATATATAACATCGTAGGTGTCTGGGTGAACAGTTTAT<br>TCCTGGCATCCACTAAATATAATGGAGCCCGCTTTTTAAGCTGGCAT<br>CCAGAAAAAAAAGAATCCCAGCACCAAAATATTGTTTTCTTCACCA<br>ACCATCAGTTCATAGGTCCATTCTCTTAGCGCAACTACAGAGAACAG<br>GGGCACAAACAGGCAAAAACGGGCACAACCTCAATGGAGTGATGC<br>AACCTGCCTGGAGTAAATGATGACACAAGGCAATTGACCCACGCAT<br>GTATCTATCTCATTTTCTTACACCTTCTATTACCTTCTGCTCTCTGA<br>TTTGGAAAAAGCTGAAAAAAAAGGTTGAAACCAGTTCCCTGAAATT<br>ATTCCCCTACTTGACTAATAAGTATATAAAGACGGTAGGTATTGATT<br>GTAATTCTGTAAATCTATTTCTTAAACTTCTTAAATTCTACTTTTATA<br>GTTAGTCTTTTTTTAGTTTTAAAACACCAAGAACTTAGTTTCGAATA<br>AACACACATAAACAAACAAAATGGAACTTCAGTACTTCTCCTATTTT<br>CAACCCACTTCATCTGTCGTAGCCCTACTACTAGCACTAGTGAGTAT<br>TTTATTTAGCGTAGTTGTTTTGAGGAAGACTTTCAGTAACAATTACTC<br>CAGCCCCGCGTCAAGTACGGAAACCGCTGTGCTGTGTCATCAGAGGC<br>AACAGAGTTGCGCCCTACCTATCAGCGGCCTTCTTCACGTGTTCATG<br>AATAAGAACGGCCTGATTCATGTCACCTTGGGAAATATGGCTGACAA<br>ATATGGCCCTATCTTCAGTTTTCCGACAGGCAGCCACCGTACTTTAGT<br>AGTCAGTTCCTGGGAAATGGTGAAAGAGTGTTTCACCGGTAATAACG<br>ACACGGCATTCTCCAACAGACCAATCCCTTTGGCTTTTCAAACCATA<br>TTCTACGCCTGTGGCGGCATTGATTCTTACGGTTTAAGTAGTGTCCCG<br>TATGGTAAATACTGGAGGGAGTTGAGAAAGGTGTGTGTTCACAACCT<br>GCTGAGTAATCAGCAATTGCTGAAGTTCAGACATCTTATAATCTCCC<br>AAGTGGATACGTCTTTTAACAAGTTGTATGAGCTGTGTAAGAACTCT<br>GAAGATAATCAAGGTATGGTAAGGATGGATGATTGGCTAGCTCAAC<br>TTTCCTTTAACGTCATCGGTAGGATCGTTTGCGGATTCCAGTCTGACC<br>CAAAGACGGGTGCACCTTCAAGGGTAGAACAGTTTAAGGAAGTCAT<br>AAATGAGGCGTCATATTTTATGTCAACAAGTCCAGTCTCCGATAACG<br>TACCAATGTTGGGATGGATCGACCAATTGACCGGTCTGACGAGGAA<br>CATGAAGCATTGTGGGAAGAAGCTTGACTTAGTAGTGGAGTCAATTA<br>TCAAGGACCATAGGCAAAGAGACGTTTTTCACGTACAAAAGGTGG<br>CGATGAGAAGGATGACGAACAGGACGACTTTATTGATATTTGCTTGA<br>GCATCATGGAGCAGCCACAGTTGCCCGGGAACAATTCTCCCCCTCAA<br>ATTCCGATCAAATCTATCGTGCTAGACATGATTGGGGGTGGTACCGA<br>CACTACGAAACTTACAACCATATGGACCCTATCACTTTTGTTGAACA<br>ATCCTCACGTGTTAGATAAAGCTAAACAAGAGGTCGACGCTCACTTT<br>CGTAAAAAGAGAAGATCAACAGATGACGCAGCAGCGGCAGTCGTTG<br>ATTTTGACGACATAAGAAATTTAGTATACATCCAAGCCATCATTAAA | | |

TABLE 1-continued

Example amino acid sequences of DRS-DRR enzymes, split DRS and DRR enzymes, and other nucleotide sequences.

| Sequence | Description | SEQ. ID NO. |
|---|---|---|
| GAAAGTATGAGGCTTTATCCAGCCAGCCCGGTGGTTGAGCGTCTTTC<br>CGGCGAGGATTGCGTTGTTGGAGGTTTTCACGTGCCTGCTGGTACGA<br>GACTATGGGCTAACGTTTGGAAGATGCAAAGAGATCCCAAAGTTTG<br>GGACGATCCTCTAGTATTCAGACCTGAAAGGTTTTTGAGCGACGAGC<br>AAAAGATGGTAGACGTTCGTGCCAAAACTATGAACTTCTGCCATTC<br>GGCGCAGGAAGAAGAATCTGTCCAGGCGTTTCCTTTAGTCTTGACCT<br>TATGCAACTTGTCCTAACCAGGTTAATCCTAGAGTTCGAAATGAAGT<br>CCCCGTCCGGCAAGGTAGATATGACCGCAACTCCAGGACTAATGTCT<br>TACAAGGTGGTTCCATTGGACATATTGCTGACTCACCGTCGTATCAA<br>GTCATGCGTTCAATTGGCGTCTTCTGAACGTGATATGGAAAGTTCTG<br>GGGTGCCTGTGATCACATTGTCCTCAGGTAAAGTAATGCCCGTACTG<br>GGCATGGGAACCTTCGAAAAGGTGGGTAAGGGGTCTGAACGTGAGC<br>GTTTAGCCATTCTTAAAGCGATCGAAGTTGGTTACCGTTACTTTGATA<br>CCGCAGCGGCATATGAAACGGAAGAAGTTCTAGGGGAAGCCATTGC<br>TGAAGCTTTACAATTGGGTCTGATAGAGAGCCGTGACGAGCTGTTCA<br>TCAGCTCAATGCTTTGGTGCACCGACGCACATCCAGACCGTGTGCTA<br>CTTGCTCTGCAAAACAGTCTGAGAAATCTAAAACTTGAATATCTAGA<br>CCTATATATGTTGCCGTTTCCTGCCAGCCTTAAGCCGGGCAAAATTA<br>CGATGGATATTCCTGAGGAGGATATTTGCCGTATGGATTATCGTTCA<br>GTCTGGAGCGCCATGGAAGAGTGTCAAAACTTAGGATTTACTAAAA<br>GTATTGGTGTAAGCAACTTTTCTTGCAAGAAATTACAAGAATTAATG<br>GCCACTGCAAATATCCCGCCCGCGGTAAATCAAGTAGAGATGTCACC<br>AGCTTTCCAACAGAAAAAACTGAGGGAATATTGTAACGCAAACAAC<br>ATATTGGTATCCGCAGTAAGCATTCTGGGATCAAACGGGACGCCCTG<br>GGGTAGTAATGCTGTTCTTGGAAGCGAAGTTTTGAAACAGATCGCGA<br>TGGCGAAAGGCAAAAGCGTTGCGCAAGTCAGTATGAGGTGGGTCTA<br>TGAGCAGGGCGCGTCTTTAGTAGTCAAGAGTTTCTCTGAAGAACGTT<br>TAAGAGAAAACCTGAATATTTTTGACTGGGAGCTTACGAAAGAAGA<br>CAATGAGAAGATAGGCGAAATCCCGCAATGTAGAATCCTTACTGCG<br>TACTTCCTTGTCTCCCCGAACGGC CCGTTTAAATCTCAGGAAGAGCT<br>TTGGGATGACAAGGCAtaaACAGGCCCCTTTTCCTTTGTCGATATCATG<br>TAATTAGTTATGTCACGCTTACATTCACGCCCTCCTCCCACATCCGCT<br>CTAACCGAAAAGGAAGGAGTTAGACAACCTGAAGTCTAGGTCCCTA<br>TTTATTTTTTTAATAGTTATGTTAGTATTAAGAACGTTATTTATATTT<br>CAAATTTTTCTTTTTTTCTGTACAAACGCGTGTACGCATGTAACATT<br>ATACTGAAAACCTTGCTTGAGAAGGTTTTGGGACGCTCGAAGGCTTT<br>AATTTGTAATCATTATCACTTTACGGGTCCTTTCCGGTGATCCGACAG<br>GTTACGGGGCGGCGACCTCGCGGGTTTTCGCTATTTATGAAAATTTT<br>CCGGTTTAAGGCGTTTCCGTTCTTCTTCGTCATAACTTAATGTTTTTA<br>TTTAAAATACCTCGCGAGTGGCAACACTGAAAATACCCATGGAGCG<br>GCGTAACCGTCGCACAGgatctaggtgaagatccttttttgataatctcatgaccaaaatcccttaacg<br>tgagttttcgttccactgagcgtcagaccccgtagaaaagatcaaaggatcttcttgagatcctttttttctgc<br>gcgtaatctgctgcttgcaaacaaaaaaaccaccgctaccagcggtggtttgtttgccggatcaagagctaccaa<br>ctcttttccgaaggtaactgccttcagcagagccgagataccaaatactgtccttctagtgtagccgtagttag<br>gccaccacttcaagaactctgtagcaccgcctacatacctcgctctgctaatcctgttaccagtggctgctgcca<br>gtggcgataagtcgtgtcttaccgggttggactcaagacgatagttaccggataaggcgcagcggtcgggctgaa<br>cggggggttcgtgcacacagcccagcttggagcgaacgacctacaccgaactgagatacctacagcgtgagcta<br>tgagaaagcgccacgcttcccgaagggagaaaggcggacaggtatccggtaagcggcagggtcggaacaggagag<br>cgcacgagggagcttccaggggaaacgcctggtatctttatagtcctgtcgggtttcgccacctctgacttgag<br>cgtcgatttttgtgatgctcgtcaggggggcggagcctatggaaaaacgccagcaacgcggcagtggaacgTGCA<br>TTATGAATTAGTTACGCTAGGGATAACAGGGTAATATAGAACCCGAACGA<br>CCGAGCGCAGCGGCGGCCGCGCTGATACCGCCGC | | |
| CCTCGCCGCAGTTAATTAAAGTCAGTGAGCGAGGAAGCGCGTAACT<br>ATAACGGTCCTAAGGTAGCGAATCCTGATGCGGTATTTTCTCCTTAC<br>GCATCTGTGCGGTATTTCACACCGCATAGATCGGCAAGTGCACAAAC<br>AATACTTAAATAAATACTACTCAGTAATAACCTATTTCTTAGCATTTT<br>TGACGAAATTTGCTATTTTGTTAGAGTCTTTTACACCATTTGTCTCCA<br>CACCTCCGCTTACATCAACACCAATAACGCCATTTAATCTAAGCGCA<br>TCACCAACATTTTCTGGCGTCAGTCCACCAGCTAACATAAAATGTAA<br>GCTTTCGGGGCTCTCTTGCCTTCCAACCCAGTCAGAAATCGAGTTCC<br>AATCCAAAAGTTCACCTGTCCCACCTGCTTCTGAATCAAACAAGGGA<br>ATAAACGAATGAGGTTTCTGTGAAGCTGCACTGAGTAGTATGTTGCA<br>GTCTTTTGGAAATACGAGTCTTTTAATAACTGGCAAACCGAGGAACT<br>CTTGGTATTCTTGCCACGACTCATCTCCATGCAGTTGGACGATATCA<br>ATGCCGTAATCATTGACCAGAGCCAAAACATCCTCCTTAAGTTGATT<br>ACGAAACACGCCAACCAAGTATTTCGGAGTGCCTGAACTATTTTTAT<br>ATGCTTTTACAAGACTTGAAATTTTCCTTGCAATAACCGGGTCAATT<br>GTTCTCTTTCTATTGGGCACACATATAATACCCAGCAAGTCAGCATC<br>GGAATCTAGAGCACATTCTGCGGCCTCTGTGCTCTGCAAGCCGCAAA<br>CTTTCACCAATGGACCAGAACTACCTGTGAAATTAATAACAGACATA<br>CTCCAAGCTGCCTTTGTGTGCTTAATCACGTATACTCACGTGCTCAAT<br>AGTCACCAATGCCCTCCCTCTTGGCCCTCTCCTTTTCTTTTTCGACC<br>GAATTAATTCTTAATCGGCAAAAAAAGAAAAGCTCCGGATCAAGAT | pDW18 | SEQ. ID NO. 25 |

TABLE 1-continued

Example amino acid sequences of DRS-DRR enzymes, split DRS and DRR enzymes, and other nucleotide sequences.

| Sequence | Description | SEQ. ID NO. |
|---|---|---|
| TGTACGTAAGGTGACAAGCTATTTTTCAATAAAGAATATCTTCCACT ACTGCCATCTGGCGTCATAACTGCAAAGTACACATATATTACGATGC TGTTCTATTAAATGCTTCCTATATTATATATATAGTAATGTCGTGATC TATGGTGCACTCTCAGTACAATCTGCTCTGATGCCGCATAGTTAAGC CAGCCCCGACACCCGCCAACACCCGCTGACGCGCCCTGACGGGCTTG TCTGCTCCCGGCATCCGCTTACAGACAAGCTGTGACGTCTCCGGGA GCTGCATGTGTCAGAGGTTTTCACCGTCATCACCGAAACGCGCGAGA CGAAAGGGCCTCGTGATACGCCTATTTTTATAGGTTAATGTCATGAT AATAATGGTTTCTTAGACGGATCGCTTGCCTGTAACTTACACGCGCC TCGTATCTTTTAATGATGGAATAATTTGGGAATTTACTCTGTGTTTAT TTATTTTTATGTTTTGTATTTGGATTTTAGAAAGTAAATAAAGAAGGT AGAAGAGTTACGGAATGAAGAAAAAAAAATAAACAAAGGTTTAAA AAATTTCAACAAAAAGCGTACTTTACATATATATTTATTAGACAAGA AAAGCAGATTAAATAGATATACATTCGATTAACGATAAGTAAAATG TAAAATCACAGGATTTTCGTGTGTGGTCTTCTACACAGACAAGGTGA AACAATTCGGCATTAATACCTGAGAGCAGGAAGAGCAAGATAAAAG GTAGTATTTGTTGGCGATCCCCCTAGAGTCTTTTACATCTTCGGAAAA CAAAAACTATTTTTTCTTTAATTTCTTTTTTTACTTTCTATTTTTAATTT ATATATTTATATTAAAAAATTTAAATTATAATTATTTTTTATAGCACGT GATGAAAAGGACCCAGGTGGCACTTTTCGGGGAAATGTGCGCGAA CCCCTATTTGTTTATTTTTCTAAATACATTCAAATATGTATCCGCTCA TGAGACAATAACCCTGATAAATGCTTCAATAATATTGAAAAAGGAA GAGTATGAGTATTCAACATTTCCGTGTCGCCCTTATTCCCTTTTTTGC GGCATTTTGCCTTCCTGTTTTTGCTCACCCAGAAACGCTGGTGAAAGT AAAAGATGCTGAAGATCAGTTGGGACGCGTAGTCTAGACCAGCCAG GACAGAAATGCCTCGACTTCGCTGCTACCCAAGGTTGCCGGGTGACG CACACCGTGGAAACGGATGAAGGCACGAACCCAGTGGACATAAGCC TGTTCGGTTCGTAAGCTGTAATGCAAGTAGCGTATGCGCTCACGCAA CTGGTCCAGAACCTTGACCGAACGCAGCGGTGGTAACGGCGCAGTG GCGGTTTTCATGGCTTGTTATGACTGTTTTTTTGGGGTACAGTCTATG CCTCGGGCATCCAAGCAGCAAGCGCGTTACGCCGTGGGTCGATGTTT GATGTTATGGAGCAGCAACGATGTTACGCAGCAGGGCAGTCGCCCT AAAACAAAGTTAAACATTATGAGGGAAGCGGTGATCGCCGAAGTAT CGACTCAACTATCAGAGGTAGTTGGCGCCATCGAGCGCCATCTCGAA CCGACGTTGCTGGCCGTACATTTGTACGGCTCCGCAGTGGATGGCGG CCTGAAGCCACACAGTGATATTGATTTGCTGGTTACGGTGACCGTAA GGCTTGATGAAACAACGCGGCGAGCTTTGATCAACGACCTTTTGGAA ACTTCGGCTTCCCCTGGAGAGAGCGAGATTCTCCGCGCTGTAGAAGT CACCATTGTTGTGCACGACGACATCATTCCGTGGCGTTATCCAGCTA AGCGCGAACTGCAATTTGGAGAATGGCAGCGCAATGACATTCTTGC AGGTATCTTCGAGCCAGCCACGATCGACATTGATCTGGCTATCTTGC TGACAAAAGCAAGAGAACATAGCGTTGCCTTGGTAGGTCCAGCGGC GGAGGAACTCTTTGATCCGGTTCCTGAACAGGATCTATTTGAGGCGC TAAATGAAACCTTAACGCTATGGAACTCGCCGCCCGACTGGGCTGGC GATGAGCGAAATGTAGTGCTTACGTTGTCCCGCATTTGGTACAGCGC AGTAACCGGCAAATCGCGCCAAGGATGTCGCTGCCGGCTGGGCA ATGGAGCGCCTGCCGGCCCAGTATCAGCCCGTCATACTTGAAGCTAG ACAGGCTTATCTTGGACAAGAAGAAGATCGCTTGGCCTCGCGCGCA GATCAGTTGGAAGAATTTGTCCACTACGTGAAAGGCGAGATCACCA AGGTAGTCGGCAAATAACCCTCGAGCATTCAAGGCGCCTTGATTATT TGACGTGGTTTGATGGCCTCCACGCACGTTGTGATATGTAGATGAGA GCGTTGGTTGGTGGATCAAGCCCACGCGTAGGCAATCCTCGAGCAG ATCCGCCAGGCGTGTATATATAGCGTGGATGGCCAGGCAACTTTAGT GCTGACACATCAGGCATATATATATGTGTGCGACGACACATGATCA TATGGCATGCATGTGCTCTGTATGTATATAAAACTCTTGTTTTCTTCT TTTCTCTAAATATTCTTTCCTTATACATTAGGACCTTTGCAGCATAAA TTACTATACTTCTATAGACACACAAACACAAATACACACTAAATT AATAATGGAACTTCAGTACTTCTCCTATTTTCAACCCACTTCATCTGT CGTAGCCCTACTACTAGCACTAGTGAGTATTTTATTTAGCGTAGTTGT TTTGAGGAAGACTTTCAGTAACAATTACTCCAGCCCCGCGTCAAGTA CGGAAACCGCTGTGCTGTGTCATCAGAGGCAACAGAGTTGCGCCCTA CCTATCAGCGGCCTTCTTCACGTGTTCATGAATAAGAACGGCCTGAT TCATGTCACCTTGGGAAATATGGCTGACAAATATGGCCCTATCTTCA GTTTTCCGACAGGCAGCCACCGTACTTTAGTAGTCAGTTCCTGGAAA ATGGTGAAAGAGTGTTTCACCGGTAATAACGACACGGCATTCTCCAA CAGACCAATCCCTTTGGCTTTTCAAACCATATTCTACGCCTGTGGCG GCATTGATTCTTACGGTTTAAGTAGTGTCCCGTATGGTAAATACTGG AGGGAGTTGAGAAAGGTGTGTGTTCACAACCTGCTGAGTAATCAGC AATTGCTGAAGTTCAGACATCTTTATAATCTCCCAAGTGGATACGTCT TTTAACAAGTTGTATGAGCTGTGTAAGAACTCTGAAGATAATCAAGG TATGGTAAGGATGGATGATTGGCTAGCTCAACTTTCCTTTAACGTCA TCGGTAGGATCGTTTGCGGATTCCAGTCTGACCCAAAGACGGGTGCA CCTTCAAGGGTAGAACAGTTTAAGGAAGTCATAAATGAGGCGTCAT ATTTTATGTCAACAAGTCCAGTCTCCGATAACGTACCAATGTTGGGA | | |

TABLE 1-continued

Example amino acid sequences of DRS-DRR enzymes, split DRS and DRR enzymes, and other nucleotide sequences.

| Sequence | Description | SEQ. ID NO. |
|---|---|---|
| TGGATCGACCAATTGACCGGTCTGACGAGGAACATGAAGCATTGTG<br>GGAAGAAGCTTGACTTAGTAGTGGAGTCAATTATCAAGGACCATAG<br>GCAAAAGAGACGTTTTTCACGTACAAAAGGTGGCGATGAGAAGGAT<br>GACGAACAGGACGACTTTATTGATATTTGCTTGAGCATCATGGAGCA<br>GCCACAGTTGCCCGGGAACAATTCTCCCCCTCAAATTCCGATCAAAT<br>CTATCGTGCTAGACATGATTGGGGGTGGTACCGACACTACGAAACTT<br>ACAACCATATGGACCCTATCACTTTTGTTGAACAATCCTCACGTGTT<br>AGATAAAGCTAAACAAGAGGTCGACGCTCACTTTCGTAAAAAGAGA<br>AGATCAACAGATGACGCAGCAGCGGCAGTCGTTGATTTTGACGACA<br>TAAGAAATTTAGTATACATCCAAGCCATCATTAAAGAAAGTATGAG<br>GCTTTATCCAGCCAGCCGGTGGTTGAGCGTCTTTCCGGCGAGGATT<br>GCGTTGTTGGAGGTTTTCACGTGCCTGCTGGTACGAGACTATGGGCT<br>AACGTTTGGAAGATGCAAAGAGATCCCAAAGTTTGGGACGATCCTCT<br>AGTATTCAGACCTGAAAGGTTTTTGAGCGACGAGCAAAAGATGGTA<br>GACGTTCGTGGCCAAAACTATGAACTTCTGCCATTCGGCGCAGGAAG<br>AAGAATCTGTCCAGGCGTTTCCTTTAGTCTTGACCTTATGCAACTTGT<br>CCTAACCAGGTTAATCCTAGAGTTCGAAATGAAGTCCCCGTCCGGCA<br>AGGTAGATATGACCGCAACTCCAGGACTAATGTCTTACAAGGTGGTT<br>CCATTGGACATATTGCTGACTCACCGTCGTATCAAGTCATGCGTTCA<br>ATTGGCGTCTTCTGAACGTGATATGGAAAGTTCTGGGGTGCCTGTGA<br>TCACATTGTCCTCAGGTAAAGTAATGCCCGTACTGGGCATGGGAACC<br>TTCGAAAAGGTGGGTAAGGGGTCTGAACGTGAGCGTTTAGCCATTCT<br>TAAAGCGATCGAAGTTGGTTACCGTTACTTTGATACCGCAGCGGCAT<br>ATGAAACGGAAGAAGTTCTAGGGGAAGCCATTGCTGAAGCTTTACA<br>ATTGGGTCTGATAGAGAGCCGTGACGAGCTGTTCATCAGCTCAATGC<br>TTTGGTGCACCGACGCACATCCAGACCGTGTGCTACTTGCTCTGCAA<br>AACAGTCTGAGAAATCTAAAACTTGAATATCTAGACCTATATATGTT<br>GCCGTTTCCTGCCAGCCTTAAGCCGGGCAAAATTACGATGGATATTC<br>CTGAGGAGGATATTTGCCGTATGGATTATCGTTCAGTCTGGAGCGCC<br>ATGGAAGAGTGTCAAAACTTAGGATTTACTAAAAGTATTGGTGTAAG<br>CAACTTTTCTTGCAAGAAATTACAAGAATTAATGGCCACTGCAAATA<br>TCCCGCCCGCGGTAAATCAAGTAGAGATGTCACCAGCTTTCCAACAG<br>AAAAAACTGAGGGAATATTGTAACGCAAACAACATATTGGTATCCG<br>CAGTAAGCATTCTGGGATCAAACGGGACGCCCTGGGGTAGTAATGC<br>TGTTCTTGGAAGCGAAGTTTTGAAACAGATCGCGATGGCGAAAGGC<br>AAAAGCGTTGCGCAAGTCAGTATGAGGTGGGTCTATGAGCAGGGCG<br>CGTCTTTAGTAGTCAAGAGTTTCTCTGAAGAACGTTTAAGAGAAAAC<br>CTGAATATTTTTGACTGGGAGCTTACGAAAGAAGACAATGAGAAGA<br>TAGGCGAAATCCCGCAATGTAGAATCCTTACTGCGTACTTCCTTGTC<br>TCCCCGAACGGCCCGTTTAAATCTCAGGAAGAGCTTTGGGATGACAA<br>GGCAtaaACAGGCCCCTTTTCCTTTGTCGATATCATGTAATTAGTTATG<br>TCACGCTTACATTCACGCCCTCCTCCCACATCCGCTCTAACCGAAAA<br>GGAAGGAGTTAGACAACCTGAAGTCTAGGTCCCTATTTATTTTTTTT<br>AATAGTTATGTTAGTATTAAGAACGTTATTTATATTTCAAATTTTTCT<br>TTTTTTCTGTACAAACGCGTGTACGCATGTAACATTATACTGAAAA<br>CCTTGCTTGAGAAGGTTTTGGGACGCTCGAAGGCTTTAATTTGTAAT<br>CATTATCACTTTACGGGTCCTTTCCGGTGATCCGACAGGTTACGGGG<br>CGGCGACCTCGCGGGTTTTCGCTATTTATGAAAATTTTCCGGTTTAAG<br>GCGTTTCCGTTCTTCTTCGTCATAACTTAATGTTTTTATTTAAAATAC<br>CTCGCGAGTGGCAACACTGAAAATACCCATGGAGCGGCGTAACCGT<br>CGCACAGgatctaggtgaagatccttttgataatctcatgaccaaaatcccttaacgtgagttttcgttccactg<br>agcgtcagacccgctagaaaagatcaaaggatcttcttgagatcctttttttctgcgcgtaatctgctgcttgcaa<br>acaaaaaaaccaccgctaccagcggtggtttgtttgccggatcaagagctaccaactctttttccgaaggtaact<br>ggcttcagcagagcgcagataccaaatactgtccttctagtgtagccgtagttaggccaccacttcaagaactct<br>gtagcaccgcctacatacctcgctctgctaatcctgttaccagtggctgctgccagtggcgataagtcgtgtctt<br>accgggttggactcaagacgatagttaccggataaggcgcagcggtcgggctgaacggggggttcgtgcacacag<br>cccagcttggagcgaacgacctacaccgaactgagatacctacagcgtgagctatgagaaagcgccacgcttccc<br>gaagggagaaaggcggacaggtatccggtaagcggcagggtcggaacaggagagcgcacgagggagcttccaggg<br>ggaaacgcctggtatctttatagtcctgtcgggtttcgccacctctgacttgagcgtcgatttttgtgatgctcg<br>tcaggggggcggagcctatggaaaaacgccagcaacgcggcagtggaacgTGCATTATGAATTAGT<br>TACGCTAGGGATAACAGGGTAATATAGAACCCGAACGACCGAGCGC<br>AGCGGCGGCCGCGCTGATACCGCCGC | | |
| CCTCGCCGCAGTTAATTAAAGTCAGTGAGCGAGGAAGCGCGTAACT<br>ATAACGGTCCTAAGGTAGCGAATCCTGATGCGGTATTTTCTCCTTAC<br>GCATCTGTGCGGTATTTCACACCGCATAGATCGGCAAGTGCACAAAC<br>AATACTTAAATAAATACTACTCAGTAATAACCCTATTTCTTAGCATTTT<br>TGACGAAATTTGCTATTTTGTTAGAGTCTTTTACACCATTTGTCTCCA<br>CACCTCCGCTTACATCAACACCAATAACGCCATTTAATCTAAGCGCA<br>TCACCAACATTTTCTGGCGTCAGTCCACCAGCTAACATAAAATGTAA<br>GCTTTCGGGGCTCTCTTGCCTTCCAACCCAGTCAGAAATCGAGTTCC<br>AATCCAAAAGTTCACCTGTCCCACCTGCTTCTGAATCAAACAAGGGA<br>ATAAACGAATGAGGTTTCTGTGAAGCTGCACTGAGTAGTATGTTGCA<br>GTCTTTTGGAAATACGAGTCTTTTAATAACTGGCAAACCGAGGAACT | pDW21 | SEQ. ID NO. 26 |

TABLE 1-continued

Example amino acid sequences of DRS-DRR enzymes, split DRS and DRR enzymes, and other nucleotide sequences.

| Sequence | Description | SEQ. ID NO. |
|---|---|---|
| CTTGGTATTCTTGCCACGACTCATCTCCATGCAGTTGGACGATATCA ATGCCGTAATCATTGACCAGAGCCAAAACATCCTCCTTAAGTTGATT ACGAAACACGCCAACCAAGTATTTCGGAGTGCCTGAACTATTTTTAT ATGCTTTTACAAGACTTGAAATTTTCCTTGCAATAACCGGGTCAATT GTTCTCTTTCTATTGGGCACACATATAATACCCAGCAAGTCAGCATC GGAATCTAGAGCACATTCTGCGGCCTCTGTGCTCTGCAAGCCGCAAA CTTTCACCAATGGACCAGAACTACCTGTGAAATTAATAACAGACATA CTCCAAGCTGCCTTTGTGCTTAATCACGTATACTCACGTGCTCAAT AGTCACCAATGCCCTCCCTCTTGGCCCTCTCCTTTTCTTTTTCGACC GAATTAATTCTTAATCGGCAAAAAAGAAAAGCTCCGGATCAAGAT TGTACGTAAGGTGACAAGCTATTTTTCAATAAAGAATATCTTCCACT ACTGCCATCTGGCGTCATAACTGCAAAGTACACATATATTACGATGC TGTTCTATTAAATGCTTCCTATATTATATATATAGTAATGTCGTGATC TATGGTGCACTCTCAGTACAATCTGCTCTGATGCCGCATAGTTAAGC CAGCCCCGACACCCGCCAACACCCGCTGACGCGCCCTGACGGGCTTG TCTGCTCCCGGCATCCGCTTACAGACAAGCTGTGACCGTCTCCGGGA GCTGCATGTGTCAGAGGTTTTCACCGTCATCACCGAAACGCGCGAGA CGAAAGGGCCTCGTGATACGCCTATTTTTATAGGTTAATGTCATGAT AATAATGGTTTCTTAGACGGATCGCTTGCCTGTAACTTACACGCGCC TCGTATCTTTTAATGATGGAATAATTTGGGAATTTACTCTGTGTTTAT TTATTTTTATGTTTTGTATTTGGATTTTAGAAAGTAAATAAAGAAGGT AGAAGAGTTACGGAATGAAGAAAAAAAAATAAACAAAGGTTTAAA AAATTTCAACAAAAAGCGTACTTTACATATATATTTATTAGACAAGA AAAGCAGATTAAATAGATATACATTCGATTAACGATAAGTAAAATG TAAAATCACAGGATTTTCGTGTGTGGTCTTCTACACAGACAAGGTGA AACAATTCGGCATTAATACCTGAGAGCAGGAAGAGCAAGATAAAAG GTAGTATTTGTTGGCGATCCCCCTAGAGTCTTTTACATCTTCGGAAAA CAAAAACTATTTTTCTTTAATTTCTTTTTTTACTTTCTATTTTTAATTT ATATATTTATATTAAAAAATTTAAATTATAATTATTTTTATAGCACGT GATGAAAAGGACCCAGGTGGCACTTTTCGGGGAAATGTGCGCGGAA CCCCTATTTGTTTATTTTTCTAAATACATTCAAATATGTATCCGCTCA TGAGACAATAACCCTGATAAATGCTTCAATAATATTGAAAAAGGAA GAGTATGAGTATTCAACATTTCCGTGTCGCCCTTATTCCCTTTTTTGC GGCATTTTGCCTTCCTGTTTTTGCTCACCCAGAAACGCTGGTGAAAGT AAAAGATGCTGAAGATCAGTTGGGACGCGTAGTCTAGACCAGCCAG GACAGAAATGCCTCGACTTCGCTGCTACCCAAGGTTGCCGGGTGACG CACACCGTGGAAACGGATGAAGGCACGAACCCAGTGGACATAAGCC TGTTCGGTTCGTAAGCTGTAATGCAAGTAGCGTATGCGCTCACGCAA CTGGTCCAGAACCTTGACCGAACGCAGCGGTGGTAACGGCGCAGTG GCGGTTTTCATGGCTTGTTATGACTGTTTTTTTGGGGTACAGTCTATG CCTCGGGCATCCAAGCAGCAAGCGCGTTACGCCGTGGGTCGATGTTT GATGTTATGGAGCAGCAACGATGTTACGCAGCAGGGCAGTCGCCCT AAAACAAAGTTAAACATTATGAGGGAAGCGGTGATCGCCGAAGTAT CGACTCAACTATCAGAGGTAGTTGGCGCCATCGAGCGCCATCTCGAA CCGACGTTGCTGGCCGTACATTTGTACGGCTCCGCAGTGGATGGCGG CCTGAAGCCACACAGTGATATTGATTTGCTGGTTACGGTGACCGTAA GGCTTGATGAAACAACGCGGCGAGCTTTGATCAACGACCTTTTGAA ACTTCGGCTTCCCCTGGAGAGAGCGAGATTCTCCGCGCTGTAGAAGT CACCATTGTTGTGCACGACGACATCATTCCGTGGCGTTATCCAGCTA AGCGCGAACTGCAATTTGGAGAATGGCAGCGCAATGACATTCTTGC AGGTATCTTCGAGCCAGCCACGATCGACATTGATCTGGCTATCTTGC TGACAAAAGCAAGAGAACATAGCGTTGCCTTGGTAGGTCCAGCGGC GGAGGAACTCTTTGATCCGGTTCCTGAACAGGATCTATTTGAGGCGC TAAATGAAACCTTAACGCTATGGAACTCGCCGCCCGACTGGGCTGGC GATGAGCGAAATGTAGTGCTTACGTTGTCCCGCATTTGGTACAGCGC AGTAACCGGCAAAATCGCGCCGAAGGATGTCGCTGCCGGCTGGGCA ATGGAGCGCCTGCCGGCCCAGTATCAGCCCGTCATACTTGAAGCTAG ACAGGCTTATCTTGGACAAGAAGAAGATCGCTTGGCCTCGCGCGCA GATCAGTTGGAAGAATTTGTCCACTACGTGAAAGGCGAGATCACCA AGGTAGTCGGCAAATAACCCTCGAGCATTCAAGGCGCCTTGATTATT TGACGTGGTTTGATGGCCTCCACGCACGTTGTGATATGTAGATGAGA GCGTTGGTTGGTGGATCAAGCCCACGCGTAGGCAATCCTCGAGCAG ATCCGCCAGGCGTGTATATATAGCGTGGATGGCCAGGCAACTTTAGT GCTGACACATACAGGCATATATATGTGTGCGACGACACATGATCA TATGGCATGCATGTGCTCTGTATGTATATAAAACTCTTGTTTTCTTCT TTTCTCTAAATATTCTTTCCTTATACATTAGGACCTTTGCAGCATAAA TTACTATACTTCTATAGACACACAAACACAAATACACACACTAAATT AATAATGGAACTTCAGTACTTCTCCTATTTTCAACCCACTTCATCTGT CGTAGCCCTACTACTAGCACTAGTGAGTATTTTATTTAGCGTAGTTGT TTTGAGGAAGACTTTCAGTAACAATTACTCCAGCCCCGCGTCAAGTA CGGAAACCGCTGTGCTGTGTCATCAGAGGCAACAGAGTTGCGCCCTA CCTATCAGCGGCCTTCTTCACGTGTTCATGAATAAGAACGGCCTGAT TCATGTCACCTTGGGAAATATGGCTGACAAATATGGCCCTATCTTCA GTTTTCCGACAGGCAGCCACCGTACTTTAGTAGTCAGTTCCTGGGAA | | |

TABLE 1-continued

Example amino acid sequences of DRS-DRR enzymes, split DRS and DRR enzymes, and other nucleotide sequences.

| Sequence | Description | SEQ. ID NO. |
|---|---|---|
| ATGGTGAAAGAGTGTTTCACCGGTAATAACGACACGGCATTCTCCAA CAGACCAATCCCTTTGGCTTTTCAAACCATATTCTACGCCTGTGGCG GCATTGATTCTTACGGTTTAAGTAGTGTCCCGTATGGTAAATACTGG AGGGAGTTGAGAAAGGTGTGTGTTCACAACCTGCTGAGTAATCAGC AATTGCTGAAGTTCAGACATCTTATAATCTCCCAAGTGGATACGTCT TTTAACAAGTTGTATGAGCTGTGTAAGAACTCTGAAGATAATCAAGG TATGGTAAGGATGGATGATTGGCTAGCTCAACTTTCCTTTAACGTCA TCGGTAGGATCGTTTGCGGATTCCAGTCTGACCCAAAGACGGGTGCA CCTTCAAGGGTAGAACAGTTTAAGGAAGTCATAAATGAGGCGTCAT ATTTTATGTCAACAAGTCCAGTCTCCGATAACGTACCAATGTTGGGA TGGATCGACCAATTGACCGGTCTGACGAGGAACATGAAGCATTGTG GGAAGAAGCTTGACTTAGTAGTGGAGTCAATTATCAAGGACCATAG GCAAAAGAGACGTTTTTCACGTACAAAAGGTGGCGATGAGAAGGAT GACGAACAGGACGACTTTATTGATATTTGCTTGAGCATCATGGAGCA GCCACAGTTGCCCGGGAACAATTCTCCCCCTCAAATTCCGATCAAAT CTATCGTGCTAGACATGATTGGGGGTGGTACCGACACTACGAAACTT ACAACCATATGGACCCTATCACTTTTGTTGAACAATCCTCACGTGTT AGATAAAGCTAAACAAGAGGTCGACGCTCACTTTCGTAAAAAGAGA AGATCAACAGATGACGCAGCAGCGGCAGTCGTTGATTTTGACGACA TAAGAAATTTAGTATACATCCAAGCCATCATTAAAGAAAGTATGAG GCTTTATCCAGCCAGCCCGGTGGTTGAGCGTCTTTCCGGCGAGGATT GCGTTGTTGGAGGTTTTCACGTGCCTGCTGGTACGAGACTATGGGCT AACGTTTGGAAGATGCAAAGAGATCCCAAAGTTTGGGACGATCCTCT AGTATTCAGACCTGAAAGGTTTTTGAGCGACGAGCAAAAGATGGTA GACGTTCGTGGCCAAAACTATGAACTTCTGCCATTCGGCGCAGGAAG AAGAATCTGTCCAGGCGTTTCCTTTAGTCTTGACCTTATGCAACTTGT CCTAACCAGGTTAATCCTAGAGTTCGAAATGAAGTCCCCGTCCGGCA AGGTAGATATGACCGCAACTCCAGGACTAATGTCTTACAAGGTGGTT CCATTGGACATATTGCTGACTCACCGTCGTATCAAGTCATGCGTTCA ATTGGCGTCTTCTGAACGTGATtaaGCGAATTTCTTATGATTTATGATT TTTATTATTAAATAAGTTATAAAAAAAATAAGTGTATACAAATTTTA AAGTGACTCTTAGGTTTTAAAACGAAAATTCTTATTCTTGAGTAACT CTTTCCTGTAGGTCAGGTTGCTTTCTCAGGTACATAGCTTCAAAATGT TTCTACTCCTTTTTTACTCTTCCAGATTTTCTCGGACTCCGCGCATCGC CGTACCACTTCAAAACACCCAAGCACAGCATACTAAATTTCCCCTCT TTCTTCCTCTAGGGTGTCGTTAATTACCCGTACTAAAGGTTTGGAAA AGAAAAAAGAGACCGCCTCGTTTCTTTTTCTTCGTCGAAAAAGGCAA TAAAAATTTTTATCACGTTTCTTTTTCTTGAAAATTTTTTTTTTTGATT TTTTTCTCTTTCGATGACCTCCCATTGATATTTAAGTTAATAAACGGT CTTCAATTTCTCAAGTTTCAGTTTCATTTTTCTTGTTCTATTACAACTT TTTTTACTTCTTGCTCATTAGAAAGAAAGCATAGCAATCTAATCTAA GTTTTAATTACAAAATGGAAAGTTCTGGGGTGCCTGTGATCACATTG TCCTCAGGTAAAGTAATGCCCGTACTGGGCATGGGAACCTTCGAAAA GGTGGGTAAGGGGTCTGAACGTGAGCGTTTAGCCATTCTTAAAGCGA TCGAAGTTGGTTACCGTTACTTTGATACCGCAGCGGCATATGAAACG GAAGAAGTTCTAGGGGAAGCCATTGCTGAAGCTTTACAATTGGGTCT GATAGAGAGCCGTGACGAGCTGTTCATCAGCTCAATGCTTTGGTGCA CCGACGCACATCCAGACCGTGTGCTACTTGCTCTGCAAAACAGTCTG AGAAATCTAAAACTTGAATATCTAGACCTATATATGTTGCCGTTTCC TGCCAGCCTTAAGCCGGGCAAAATTACGATGGATATTCCTGAGGAG GATATTTGCCGTATGGATTATCGTTCAGTCTGGAGCGCCATGGAAGA GTGTCAAAACTTAGGATTTACTAAAAGTATTGGTGTAAGCAACTTTT CTTGCAAGAAATTACAAGAATTAATGGCCACTGCAAATATCCCGCCC GCGGTAAATCAAGTAGAGATGTCACCAGCTTTCCAACAGAAAAAAC TGAGGGAATATTGTAACGCAAACAACATATTGGTATCCGCAGTAAG CATTCTGGGATCAAACGGGACGCCCTGGGGTAGTAATGCTGTTCTTG GAAGCGAAGTTTTGAAACAGATCGCGATGCGAAAGGCAAAAGCGT TGCGCAAGTCAGTATGAGGTGGGTCTATGAGCAGGGCGCGTCTTTAG TAGTCAAGAGTTTCTCTGAAGAACGTTTAAGAGAAAACCTGAATATT TTTGACTGGGAGCTTACGAAAGAAGACAATGAGAAGATAGGCGAAA TCCCGCAATGTAGAATCCTTACTGCGTACTTCCTTGTCTCCCCGAACG GCCCGTTTAAATCTCAGGAAGAGCTTTGGGATGACAAGGCAtaaACAG GCCCCTTTTCCTTTGTCGATATCATGTAATTAGTTATGTCACGCTTAC ATTCACGCCCTCCTCCCACATCCGCTCTAACCGAAAAGGAAGGAGTT AGACAACCTGAAGTCTAGGTCCCTATTTATTTTTTTAATAGTTATGT TAGTATTAAGAACGTTATTTATATTTCAAATTTTTCTTTTTTTTCTGTA CAAACGCGTGTACGCATGTAACATTATACTGAAAACCTTGCTTGAGA AGGTTTTGGGACGCTCGAAGGCTTTAATTTGTAATCATTATCACTTTA CGGGTCCTTTCCGGTGATCCGACAGGTTACGGGCGGCGACCTCGCG GGTTTTCGCTATTTATGAAATTTTCCGGTTTAAGGCGTTTCCGTTCT TCTTCGTCATAACTTAATGTTTTTATTTAAAATACCTCGCGAGTGGCA ACACTGAAAATACCCATGGAGCGGCGTAACCGTCGCACAGgatctaggtg aagatccttttgataatctcatgaccaaaatcccttaacgtgagttttcgttccactgagcgtcagacccgta gaaaagatcaaaggatcttcttgagatcctttttttctgcgcgtaatctgctgcttgcaaacaaaaaaaccaccg | | |

TABLE 1-continued

Example amino acid sequences of DRS-DRR enzymes, split DRS and DRR enzymes, and other nucleotide sequences.

| Sequence | Description | SEQ. ID NO. |
|---|---|---|
| ctaccagcggtggtttgtttgccggatcaagagctaccaactcttttttccgaaggtaactggcttcagcagagcg cagataccaaatactgtccttctagtgtagccgtagttaggccaccacttcaagaactctgtagcaccgcctaca tacctcgctctgctaatcctgttaccagtggctgctgccagtggcgataagtcgtgtcttaccggggttggactca agacgatagttaccggataaggcgcagcggtcgggctgaacggggggttcgtgcacacagcccagcttggagcga acgacctacaccgaactgagatacctacagcgtgagctatgagaaagcgccacgcttcccgaagggagaaaggcg gacaggtatccggtaagcggcagggtcggaacaggagagcgcacgagggagcttccaggggggaaacgcctggtat ctttatagtcctgtcgggtttcgccacctctgactttgagcgtcgattttgtgatgctcgtcaggggggcggagc ctatggaaaaacgccagcaacgcggcagtggaacgTGCATTATGAATTAGTTACGCTAGGGATAAC AGGGTAATATAGAACCCGAACGACCGAGCGCAGCGGCGGCCGCGCT GATACCGCCGC | | |
| CCTCGCCGCAGTTAATTAAAGTCAGTGAGCGAGGAAGCGCGTAACT ATAACGGTCCTAAGGTAGCGAATCCTGATGCGGTATTTTCTCCTTAC GCATCTGTGCGGTATTTCACACCGCATAGATCGGCAAGTGCACAAAC AATACTTAAATAAATACTACTCAGTAATAACCTATTTCTTAGCATTTT TGACGAAATTTGCTATTTTGTTAGAGTCTTTTACACCATTTGTCTCCA CACCTCCGCTTACATCAACACCAATAACGCCATTTAATCTAAGCGCA TCACCAACATTTTCTGGCGTCAGTCCACCAGCTAACATAAAATGTAA GCTTTCGGGGCTCTCTTGCCTTCCAACCCAGTCAGAAATCGAGTTCC AATCCAAAAGTTCACCTGTCCCACCTGCTTCTGAATCAAACAAGGGA ATAAACGAATGAGGTTTCTGTGAAGCTGCACTGAGTAGTATGTTGCA GTCTTTTGGAAATACGAGTCTTTTAATAACTGGCAAACCGAGGAACT CTTGGTATTCTTGCCACGACTCATCTCCATGCAGTTGGACGATATCA ATGCCGTAATCATTGACCAGAGCCAAAACATCCTCCTTAAGTTGATT ACGAAACACGCCAACCAAGTATTTCGGAGTCCTGAACTATTTTTAT ATGCTTTTACAAGACTTGAAATTTTCCTTGCAATAACCGGGTCAATT GTTCTCTTTCTATTGGGCACACATATAATACCCAGCAAGTCAGCATC GGAATCTAGAGCACATTCTGCGGCCTCTGTGCTCTGCAAGCCGCAAA CTTTCACCAATGGACCAGAACTACCTGTGAAATTAATAACAGACATA CTCCAAGCTGCCTTTGTGCTTAATCACGTATACTCACGTGCTCAAT AGTCACCAATGCCCTCCCTCTTGGCCCTCTCCTTTTCTTTTTTCGACC GAATTAATTCTTAATCGGCAAAAAAAGAAAAGCTCCGGATCAAGAT TGTACGTAAGGTGACAAGCTATTTTTCAATAAAGAATATCTTCCACT ACTGCCATCTGGCGTCATAACTGCAAAGTACACATATATTACGATGC TGTTCTATTAAATGCTTCCTATATTATATATATAGTAATGTCGTGATC TATGGTGCACTCTCAGTACAATCTGCTCTGATGCCGCATAGTTAAGC CAGCCCCGACACCCGCCAACACCCGCTGACGCGCCCTGACGGGCTTG TCTGCTCCCGGCATCCGCTTACAGACAAGCTGTGACCGTCTCCGGGA GCTGCATGTGTCAGAGGTTTTCACCGTCATCACCGAAACGCGCGAGA CGAAAGGGCCTCGTGATACGCCTATTTTTATAGGTTAATGTCATGAT AATAATGGTTTCTTAGACGGATCGCTTGCCTGTAACTTACACGCGCC TCGTATCTTTTAATGATGGAATAATTTGGGAATTTACTCTGTGTTTAT TTATTTTTATGTTTTGTATTTGGATTTTAGAAAGTAAATAAAGAAGGT AGAAGAGTTACGGAATGAAGAAAAAAAAAATAAACAAAGGTTTAAA AAATTTCAACAAAAAGCGTACTTTACATATATATTTATTAGACAAGA AAAGCAGATTAAATAGATATACATTCGATTAACGATAAGTAAAATG TAAAATCACAGGATTTTCGTGTGTGGTCTTCTACACAGACAAGGTGA AACAATTCGGCATTAATACCTGAGAGCAGGAAGAGCAAGATAAAAG GTAGTATTTGTTGGCGATCCCCCTAGAGTCTTTTACATCTTCGGAAAA CAAAAACTATTTTTCTTTAATTTCTTTTTTTACTTTCTATTTTTAATTT ATATATTTATATTAAAAAATTTAAATTATAATTATTTTTATAGCACGT GATGAAAAGGACCCAGGTGGCACTTTTCGGGGAAATGTGCGCGGAA CCCCTATTTGTTTATTTTTCTAAATACATTCAAATATGTATCCGCTCA TGAGACAATAACCCTGATAAATGCTTCAATAATATTGAAAAAGGAA GAGTATGAGTATTCAACATTTCCGTGTCGCCCTTATTCCCTTTTTTGC GGCATTTTGCCTTCCTGTTTTTGCTCACCCAGAAACGCTGGTGAAAGT AAAAGATGCTGAAGATCAGTTGGGACGCGTAGTCTAGACCAGCCAG GACAGAAATGCCTCGACTTCGCTGCTACCCAAGGTTGCCGGGTGACG CACACCGTGGAAACGGATGAAGGCACGAACCCAGTGGACATAAGCC TGTTCGGTTCGTAAGCTGTAATGCAAGTAGCGTATGCGCTCACGCAA CTGGTCCAGAACCTTGACCGAACGCAGCGGTGGTAACGGCGCAGTG GCGGTTTTCATGGCTTGTTATGACTGTTTTTTTGGGGTACAGTCTATG CCTCGGGCATCCAAGCAGCAAGCGCGTTACGCCGTGGGTCGATGTTT GATGTTATGGAGCAGCAACGATGTTACGCAGCAGGGCAGTCGCCCT AAAACAAAGTTAAACATTATGAGGGAAGCGGTGATCGCCGAAGTAT CGACTCAACTATCAGAGGTAGTTGGCGCCATCGAGCGCCATCTCGAA CCGACGTTGCTGGCCGTACATTTGTACGGCTCCGCAGTGGATGGCGG CCTGAAGCCACACAGTGATATTGATTTGCTGGTTACGGTGACCGTAA GGCTTGATGAAACGCGGCGAGCTTTGATCAACGACCTTTTGGAA ACTTCGGCTTCCCCTGGAGAGAGCGAGATTCTCCGCGCTGTAGAAGT CACCATTGTTGTGCACGACGACATCATTCCGTGGCGTTATCCAGCTA AGCGCGAACTGCAATTTGGAGAATGGCAGCGCAATGACATTCTTGC AGGTATCTTCGAGCCAGCCACGATCGACATTGATCTGGCTATCTTGC TGACAAAAGCAAGAGAACATAGCGTTGCCTTGGTAGGTCCAGCGGC | pJL29 | SEQ. ID NO. 27 |

TABLE 1-continued

Example amino acid sequences of DRS-DRR enzymes, split DRS and DRR enzymes, and other nucleotide sequences.

| Sequence | Description | SEQ. ID NO. |
|---|---|---|
| GGAGGAACTCTTTGATCCGGTTCCTGAACAGGATCTATTTGAGGCGC<br>TAAATGAAACCTTAACGCTATGGAACTCGCCGCCCGACTGGGCTGGC<br>GATGAGCGAAATGTAGTGCTTACGTTGTCCCGCATTTGGTACAGCGC<br>AGTAACCGGCAAATCGCGCCGAAGGATGTCGCTGCCGGCTGGGCA<br>ATGGAGCGCCTGCCGGCCCAGTATCAGCCCGTCATACTTGAAGCTAG<br>ACAGGCTTATCTTGGACAAGAAGAAGATCGCTTGGCCTCGCGCGCA<br>GATCAGTTGGAAGAATTTGTCCACTACGTGAAAGGCGAGATCACCA<br>AGGTAGTCGGCAAATAACCCTCGAGCATTCAAGGCGCCTTGATTATT<br>TGACGTGGTTTGATGGCCTCCACGCACGTTGTGATATGTAGATGATT<br>CAGTTCGAGTTTATCATTATCAATACTGCCATTTCAAAGAATACGTA<br>AATAATTAATAGTAGTGATTTTCCTAACTTTATTTAGTCAAAAAATTA<br>GCCTTTTAATTCTGCTGTAACCCGTACATGCCCAAAATAGGGGCGG<br>GTTACACAGAATATATAACATCGTAGGTGTCTGGGTGAACAGTTTAT<br>TCCTGGCATCCACTAAATATAATGGAGCCCGCTTTTTAAGCTGGCAT<br>CCAGAAAAAAAAGAATCCCAGCACCAAAATATTGTTTTCTTCACCA<br>ACCATCAGTTCATAGGTCCATTCTCTTAGCGCAACTACAGAGAACAG<br>GGGCACAAACAGGCAAAAACGGGCACAACCTCAATGGAGTGATGC<br>AACCTGCCTGGAGTAAATGATGACACAAGGCAATTGACCCACGCAT<br>GTATCTATCTCATTTTCTTACACCTTCTATTACCTTCTGCTCTCTGA<br>TTTTGGAAAAGCTGAAAAAAAAGGTTGAAACCAGTTCCCTGAAATT<br>ATTCCCCTACTTGACTAATAAGTATATAAAGACGGTAGGTATTGATT<br>GTAATTCTGTAAATCTATTTCTTAAACTTCTTAAATTCTACTTTTATA<br>GTTAGTCTTTTTTTTAGTTTTAAAACACCAAGAACTTAGTTTCGAATA<br>AACACACATAAACAAACAAATGGAACTTCAGTACTTCTCCTATTTT<br>CAACCCACTTCATCTGTCGTAGCCCTACTACTAGCACTAGTGAGTAT<br>TTTATTTAGCGTAGTTGTTTGAGGAAGACTTTCAGTAACAATTACTC<br>CAGCCCCGCGTCAAGTACGGAAACCGCTGTGCTGTGTCATCAGAGGC<br>AACAGAGTTGCGCCCTACCTATCAGCGGCCTTCTTCACGTGTTCATG<br>AATAAGAACGGCCTGATTCATGTCACCTTGGGAAATATGGCTGACAA<br>ATATGGCCCTATCTTCAGTTTTCCGACAGGCAGCCACCGTACTTTAGT<br>AGTCAGTTCCTGGGAAATGGTGAAAGAGTGTTTCACCGGTAATAACG<br>ACACGGCATTCTCCAACAGACCAATCCCTTTGGCTTTTCAAACCATA<br>TTCTACGCCTGTGGCGGCATTGATTCTTACGGTTTAAGTAGTGTCCCG<br>TATGGTAAATACTGGAGGGAGTTGAGAAAGGTGTGTGTTCACAACCT<br>GCTGAGTAATCAGCAATTGCTGAAGTTCAGACATCTTATAATCTCCC<br>AAGTGGATACGTCTTTTAACAAGTTGTATGAGCTGTGTAAGAACTCT<br>GAAGATAATCAAGGTATGGTAAGGATGGATGATTGGCTAGCTCAAC<br>TTTCCTTTAACGTCATCGGTAGGATCGTTTGCGGATTCCAGTCTGACC<br>CAAAGACGGGTGCACCTTCAAGGGTAGAACAGTTTAAGGAAGTCAT<br>AAATGAGGCGTCATATTTTATGTCAACAAGTCCAGTCTCCGATAACG<br>TACCAATGTTGGGATGGATCGACCAATTGACCGGTCTGACGAGGAA<br>CATGAAGCATTGTGGGAAGAAGCTTGACTTAGTAGTGGAGTCAATTA<br>TCAAGGACCATAGGCAAAAGAGACGTTTTTCACGTACAAAAGGTGG<br>CGATGAGAAGGATGACGAACAGGACGACTTTATTGATATTTGCTTGA<br>GCATCATGGAGCAGCCACAGTTGCCCGGGAACAATTCTCCCCCTCAA<br>ATTCCGATCAAATCTATCGTGCTAGACATGATTGGGGGTGGTACCGA<br>CACTACGAAACTTACAACCATATGGACCCTATCACTTTTGTTGAACA<br>ATCCTCACGTGTTAGATAAAGCTAAACAAGAGGTCGACGCTCACTTT<br>CGTAAAAAGAGAAGATCAACAGATGACGCAGCAGCGGCAGTCGTTG<br>ATTTTGACGACATAAGAAATTTAGTATACATCCAAGCCATCATTAAA<br>GAAAGTATGAGGCTTTATCCAGCCAGCCCGGTGGTTGAGCGTCTTTC<br>CGGCGAGGATTGCGTTGTTGGAGGTTTTCACGTGCCTGCTGGTACGA<br>GACTATGGGCTAACGTTTGGAAGATGCAAAGAGATCCCAAAGTTTG<br>GGACGATCCTCTAGTATTCAGACCTGAAAGGTTTTTGAGCGACGAGC<br>AAAAGATGGTAGACGTTCGTGGCCAAAACTATGAACTTCTGCCATTC<br>GGCGCAGGAAGAAGAATCTGTCCAGGCGTTTCCTTTAGTCTTGACCT<br>TATGCAACTTGTCCTAACCAGGTTAATCCTAGAGTTCGAAATGAAGT<br>CCCCGTCCGGCAAGGTAGATATGACCGCAACTCCAGGACTAATGTCT<br>TACAAGGTGGTTCCATTGGACATATTGCTGACTCACCGTCGTATCAA<br>GTCATGCGTTCAATTGGCGTCTTCTGAACGTGATtaaGCGAATTTCTTA<br>TGATTTATGATTTTTATTATTAAATAAGTTATAAAAAAAATAAGTGT<br>ATACAAATTTTAAAGTGACTCTTAGGTTTTAAAACGAAAATTCTTAT<br>TCTTGAGTAACTCTTTCCTGTAGGTCAGGTTGCTTTCTCAGGTACATA<br>GCTTCAAAATGTTTCTACTCCTTTTTACTCTTCCAGATTTTCTCGGAC<br>TCCGCGCATCGCCGTACCACTTCAAAACACCCAAGCACAGCATACTA<br>AATTTCCCCTCTTTCTTCCTCTAGGGTGTCGTTAATTACCCGTACTAA<br>AGGTTTGGAAAAGAAAAAGAGACCGCCTCGTTTCTTTTTCTTCGTC<br>GAAAAAGGCAATAAAAATTTTTATCACGTTTCTTTTTCTTGAAAATTT<br>TTTTTTTTGATTTTTTTCTCTTTCGATGACCTCCCATTGATATTTAAGT<br>TAATAAACGGTCTTCAATTTCTCAAGTTTCAGTTTCATTTTTCTTGTTC<br>TATTACAACTTTTTTTACTTCTTGCTCATTAGAAAGAAAGCATAGCAA<br>TCTAATCTAAGTTTTAATTACAAAATGGAAAGTTCTGGGGTGCCTGT<br>GATCACATTGTCCTCAGGTAAAGTAATGCCCGTACTGGGCATGGGAA<br>CCTTCGAAAAGGTGGGTAAGGGGTCTGAACGTGAGCGTTTAGCCATT | | |

TABLE 1-continued

Example amino acid sequences of DRS-DRR enzymes, split DRS and DRR enzymes, and other nucleotide sequences.

| Sequence | Description | SEQ. ID NO. |
|---|---|---|
| CTTAAAGCGATCGAAGTTGGTTACCGTTACTTTGATACCGCAGCGGC<br>ATATGAAACGGAAGAAGTTCTAGGGGAAGCCATTGCTGAAGCTTTA<br>CAATTGGGTCTGATAGAGAGCCGTGACGAGCTGTTCATCAGCTCAAT<br>GCTTTGGTGCACCGACGCACATCCAGACCGTGTGCTACTTGCTCTGC<br>AAAACAGTCTGAGAAATCTAAAACTTGAATATCTAGACCTATATATG<br>TTGCCGTTTCCTGCCAGCCTTAAGCCGGGCAAAATTACGATGGATAT<br>TCCTGAGGAGGATATTTGCCGTATGGATTATCGTTCAGTCTGGAGCG<br>CCATGGAAGAGTGTCAAAACTTAGGATTTACTAAAAGTATTGGTGTA<br>AGCAACTTTTCTTGCAAGAAATTACAAGAATTAATGCCACTGCAAA<br>TATCCCGCCCGCGGTAAATCAAGTAGAGATGTCACCAGCTTTCCAAC<br>AGAAAAAACTGAGGGAATATTGTAACGCAAACAACATATTGGTATC<br>CGCAGTAAGCATTCTGGGATCAAACGGGACGCCCTGGGGTAGTAAT<br>GCTGTTCTTGGAAGCGAAGTTTTGAAACAGATCGCGATGGCGAAAG<br>GCAAAAGCGTTGCGCAAGTCAGTATGAGGTGGGTCTATGAGCAGGG<br>CGCGTCTTTAGTAGTCAAGAGTTTCTCTGAAGAACGTTTAAGAGAAA<br>ACCTGAATATTTTTGACTGGGAGCTTACGAAAGAAGACAATGAGAA<br>GATAGGCGAAATCCCGCAATGTAGAATCCTTACTGCGTACTTCCTTG<br>TCTCCCCGAACGGCCCGTTTAAATCTCAGGAAGAGCTTTGGGATGAC<br>AAGGCAtaaACAGGCCCCTTTTCCTTTGTCGATATCATGTAATTAGTTA<br>TGTCACGCTTACATTCACGCCCTCCTCCCACATCCGCTCTAACCGAA<br>AAGGAAGGAGTTAGACAACCTGAAGTCTAGGTCCCTATTTATTTTTT<br>TTAATAGTTATGTTAGTATTAAGAACGTTATTTATATTTCAAATTTTT<br>CTTTTTTTTCTGTACAAACGCGTGTACGCATGTAACATTATACTGAAA<br>ACCTTGCTTGAGAAGGTTTTGGGACGCTCGAAGGCTTTAATTTGTAA<br>TCATTATCACTTTACGGGTCCTTTCCGGTGATCCGACAGGTTACGGG<br>GCGGCGACCTCGCGGGTTTTCGCTATTTATGAAAATTTTCCGGTTTAA<br>GGCGTTTCCGTTCTTCTTCGTCATAACTTAATGTTTTTATTTAAAATA<br>CCTCGCGAGTGGCAACACTGAAAATACCCATGGAGCGGCGTAACCG<br>TCGCACAGgatctaggtgaagatccttttgataatctcatgaccaaaatcccttaacgtgagttttcgttccac<br>tgagcgtcagacccgtagaaaagatcaaggatcttcttgagatcctttttttctgcgcgtaatctgctgcttg<br>caaacaaaaaaaccaccgctaccagcggtggtttgtttgccggatcaagagctaccaactctttttccgaaggta<br>actggcttcagcagagcgcagataccaaatactgtccttctagtgtagccgtagttaggccaccacttcaagaac<br>tctgtagcaccgcctacatacctcgctctgctaatcctgttaccagtggctgctgccagtggcgataagtcgtgt<br>cttaccgggttggactcaagacgatagttaccggataaggcgcagcggtcgggctgaacggggggttcgtgcaca<br>cagcccagcttggagcgaacgacctacaccgaactgagatacctacagcgtgagctatgagaaagcgccacgctt<br>cccgaaggagagaaaggcggacaggtatccggtaagcggcagggtcggaacaggagagcgcacgagggagcttcca<br>gggggaaacgcctggtatctttatagtcctgtcgggtttcgccacctctgacttgagcgtcgatttttgtgatgc<br>tcgtcagggggggcggagcctatggaaaaacgccagcaacgcggcagtggaacgTGCATTATGAATTAGT<br>TACGCTAGGGATAACAGGGTAATATAGAACCCGAACGACCGAGCGC<br>AGCGGCGGCCGCGCTGATACCGCCGC | | |
| CCTCGCCGCAGTTAATTAAAGTCAGTGAGCGAGGAAGCGCGTAACT<br>ATAACGGTCCTAAGGTAGCGAATCCTGATGCGGTATTTTCTCCTTAC<br>GCATCTGTGCGGTATTTCACACCGCATAGATCGGCAAGTGCACAAAC<br>AATACTTAAATAAATACTACTCAGTAATAACCTATTTCTTAGCATTTT<br>TGACGAAATTTGCTATTTTGTTAGAGTCTTTTACACCATTTGTCTCCA<br>CACCTCCGCTTACATCAACACCAATAACGCCATTTAATCTAAGCGCA<br>TCACCAACATTTTCTGGCGTCAGTCCACCAGCTAACATAAAATGTAA<br>GCTTTCGGGGCTCTCTTGCCTTCCAACCCAGTCAGAAATCGAGTTCC<br>AATCCAAAAGTTCACCTGTCCCACCTGCTTCTGAATCAAACAAGGGA<br>ATAAACGAATGAGGTTTCTGTGAAGCTGCACTGAGTAGTATGTTGCA<br>GTCTTTTGGAAATACGAGTCTTTTAATAACTGGCAAACCGAGGAACT<br>CTTGGTATTCTTGCCACGACTCATCTCCATGCAGTTGGACGATATCA<br>ATGCCGTAATCATTGACCAGAGCCAAAACATCCTCCTTAAGTTGATT<br>ACGAAACACGCCAACCAAGTATTTCGGAGTGCCTGAACTATTTTTAT<br>ATGCTTTTACAAGACTTGAAATTTTCCTTGCAATAACCGGGTCAATT<br>GTTCTCTTTCTATTGGGCACACATATAATACCCAGCAAGTCAGCATC<br>GGAATCTAGAGCACATTCTGCGGCCTCTGTGCTCTGCAAGCCGCAAA<br>CTTTCACCAATGGACCAGAACTACCTGTGAAATTAATAACAGACATA<br>CTCCAAGCTGCCTTTGTGTGCTTAATCACGTATACTCACGTGCTCAAT<br>AGTCACCAATGCCCTCCCTCTTGGCCCTCTCCTTTTCTTTTTCGACC<br>GAATTAATTCTTAATCGGCAAAAAAAGAAAAGCTCCGGATCAAGAT<br>TGTACGTAAGGTGACAAGCTATTTTTCAATAAAGAATATCTTCCACT<br>ACTGCCATCTGGCGTCATAACTGCAAAGTACACATATATTACGATGC<br>TGTTCTATTAAATGCTTCCTATATTATATATATAGTAATGTCGTGATC<br>TATGGTGCACTCTCAGTACAATCTGCTCTGATGCCGCATAGTTAAGC<br>CAGCCCCGACACCCGCCAACACCCGCTGACGCGCCCTGACGGGCTTG<br>TCTGCTCCCGGCATCCGCTTACAGACAAGCTGTGACCGTCTCCGGGA<br>GCTGCATGTGTCAGAGGTTTTCACCGTCATCACCGAAACGCGCGAGA<br>CGAAAGGGCCTCGTGATACGCCTATTTTTATAGGTTAATGTCATGAT<br>AATAATGGTTTCTTAGACGGATCGCTTGCCTGTAACTTACACGCGCC<br>TCGTATCTTTTAATGATGGAATAATTTGGGAATTTACTCTGTGTTTAT<br>TTATTTTTATGTTTTGTATTTGGATTTTAGAAAGTAAATAAGAAGGT<br>AGAAGAGTTACGGAATGAAGAAAAAAAAATAAACAAAGGTTTAAA | pJL32 | SEQ. ID<br>NO. 28 |

TABLE 1-continued

Example amino acid sequences of DRS-DRR enzymes, split DRS and DRR enzymes, and other nucleotide sequences.

| Sequence | Description | SEQ. ID NO. |
|---|---|---|
| AAATTTCAACAAAAAGCGTACTTTACATATATATTTATTAGACAAGA<br>AAAGCAGATTAAATAGATATACATTCGATTAACGATAAGTAAAATG<br>TAAAATCACAGGATTTTCGTGTGTGGTCTTCTACACAGACAAGGTGA<br>AACAATTCGGCATTAATACCTGAGAGCAGGAAGAGCAAGATAAAAG<br>GTAGTATTTGTTGGCGATCCCCCTAGAGTCTTTTACATCTTCGGAAAA<br>CAAAAACTATTTTTTCTTTAATTTCTTTTTTTACTTTCTATTTTTAATTT<br>ATATATTTATATTAAAAAATTTAAATTATAATTATTTTTATAGCACGT<br>GATGAAAAGGACCCAGGTGGCACTTTTCGGGGAAATGTGCGCGGAA<br>CCCCTATTTGTTTATTTTTCTAAATACATTCAAATATGTATCCGCTCA<br>TGAGACAATAACCCTGATAAATGCTTCAATAATATTGAAAAAGGAA<br>GAGTATGAGTATTCAACATTTCCGTGTCGCCCTTATTCCCTTTTTTGC<br>GGCATTTTGCCTTCCTGTTTTTGCTCACCCAGAAACGCTGGTGAAAGT<br>AAAAGATGCTGAAGATCAGTTGGGACGCGTAGTCTAGACCAGCCAG<br>GACAGAAATGCCTCGACTTCGCTGCTACCCAAGGTTGCCGGGTGACG<br>CACACCGTGGAAACGGATGAAGGCACGAACCCAGTGGACATAAGCC<br>TGTTCGGTTCGTAAGCTGTAATGCAAGTAGCGTATGCGCTCACGCAA<br>CTGGTCCAGAACCTTGACCGAACGCAGCGGTGGTAACGGCGCAGTG<br>GCGGTTTTCATGGCTTGTTATGACTGTTTTTTTGGGGTACAGTCTATG<br>CCTCGGGCATCCAAGCAGCAAGCGCGTTACGCCGTGGGTCGATGTTT<br>GATGTTATGGAGCAGCAACGATGTTACGCAGCAGGGCAGTCGCCCT<br>AAAACAAAGTTAAACATTATGAGGGAAGCGGTGATCGCCGAAGTAT<br>CGACTCAACTATCAGAGGTAGTTGGCGCCATCGAGCGCCATCTCGAA<br>CCGACGTTGCTGGCCGTACATTTGTACGGCTCCGCAGTGGATGGCGG<br>CCTGAAGCCACACAGTGATATTGATTTGCTGGTTACGGTGACCGTAA<br>GGCTTGATGAAACAACGCGGCGAGCTTTGATCAACGACCTTTTGGAA<br>ACTTCGGCTTCCCCTGGAGAGAGCGAGATTCTCCGCGCTGTAGAAGT<br>CACCCATTGTTGTGCACGACGACATCATTCCGTGGCGTTATCCAGCTA<br>AGCGCGAACTGCAATTTGGAGAATGGCAGCGCAATGACATTCTTGC<br>AGGTATCTTCGAGCCAGCCACGATCGACATTGATCTGGCTATCTTGC<br>TGACAAAAGCAAGAGAACATAGCGTTGCCTTGGTAGGTCCAGCGGC<br>GGAGGAACTCTTTGATCCGGTTCCTGAACAGGATCTATTTGAGGCGC<br>TAAATGAAACCTTAACGCTATGGAACTCGCCGCCCGACTGGGCTGGC<br>GATGAGCGAAATGTAGTGCTTACGTTGTCCCGCATTTGGTACAGCGC<br>AGTAACCGGCAAATCGCGCCGAAGGATGTCGCTGCCGGCTGGGCA<br>ATGGAGCGCCTGCCGGCCCAGTATCAGCCCGTCATACTTGAAGCTAG<br>ACAGGCTTATCTTGGACAAGAAGATCGCTTGGCCTCGCGCGCA<br>GATCAGTTGGAAGAATTTGTCCACTACGTGAAAGGCGAGATCACCA<br>AGGTAGTCGGCAAATAACCCTCGAGCATTCAAGGCGCCTTGATTATT<br>TGACGTGGTTTGATGGCCTCCACGCACGTTGTGATATGTAGATGAGA<br>GCGTTGGTTGGTGGATCAAGCCCACGCGTAGGCAATCCTCGAGCAG<br>ATCCGCCAGGCGTGTATATATAGCGTGGATGGCCAGGCAACTTTAGT<br>GCTGACACATCAGGCATATATATATGTGCGACGACACATGATCA<br>TATGGCATGCATGTGCTCTGTATGTATATAAAACTCTTGTTTTCTTCT<br>TTTCTCTAAATATTCTTTCCTTATACATTAGGACCTTTGCAGCATAAA<br>TTACTATACTTCTATAGACACACAAACACAAATACACACACTAAATT<br>AATAATGGAACTTCAGTACTTCTCCTATTTTCAACCCACTTCATCTGT<br>CGTAGCCCTACTACTAGCACTAGTGAGTATTTTATTTAGCGTAGTTGT<br>TTTGAGGAAGACTTTCAGTAACAATTACTCCAGCCCCGCGTCAAGTA<br>CGGAAACCGCTGTGCTGTGTCATCAGAGGCAACAGAGTTGCGCCCTA<br>CCTATCAGCGGCCTTCTTCACGTGTTCATGAATAAGAACGGCCTGAT<br>TCATGTCACCTTGGGAAATATGGCTGACAAATATGGCCCTATCTTCA<br>GTTTTCCGACAGGCAGCCACCGTACTTTAGTAGTCAGTTCCTGGGAA<br>ATGGTGAAAGAGTGTTTCACCGGTAATAACGACACGGCATTCTCCAA<br>CAGACCAATCCCTTTGGCTTTTCAAACCATATTCTACGCCTGTGGCG<br>GCATTGATTCTTACGGTTTAAGTAGTGTCCCGTATGGTAAATACTGG<br>AGGGAGTTGAGAAAGGTGTGTGTTCACAACCTGCTGAGTAATCAGC<br>AATTGCTGAAGTTCAGACATCTTATAATCTCCCAAGTGGATACGTCT<br>TTTAACAAGTTGTATGAGCTGTGTAAGAACTCTGAAGATAATCAAGG<br>TATGGTAAGGATGGATGATTGGCTAGCTCAACTTTCCTTTAACGTCA<br>TCGGTAGGATCGTTTGCGGATTCCAGTCTGACCCAAAGACGGGTGCA<br>CCTTCAAGGGTAGAACAGTTTAAGGAAGTCATAAATGAGGCGTCAT<br>ATTTTATGTCAACAAGTCCAGTCTCCGATAACGTACCAATGTTGGGA<br>TGGATCGACCAATTGACCGGTCTGACGAGGAACATGAAGCATTGTG<br>GGAAGAAGCTTGACTTAGTAGTGGAGTCAATTATCAAGGACCATAG<br>GCAAAAGAGACGTTTTTCACGTACAAAAGGTGGCGATGAGAAGGAT<br>GACGAACAGGACGACTTTATTGATATTTGCTTGAGCATCATGGAGCA<br>GCCACAGTTGCCCGGGAACAATTCTCCCCCTCAAATTCCGATCAAAT<br>CTATCGTGCTAGACATGATTGGGGTGGTACCGACACTACGAAACTTT<br>ACAACCATATGGACCCTATCACTTTTGTTGAACAATCCTCACGTGTT<br>AGATAAAGCTAAACAAGAGGTCGACGCTCACTTTCGTAAAAAGAGA<br>AGATCAACAGATGACGCAGCAGCGGCAGTCGTTGATTTTGACGACA<br>TAAGAAATTTAGTATACATCCAAGCCATCATTAAAGAAAGTATGAG<br>GCTTTATCCAGCCAGCCCGGTGGTTGAGCGTCTTTCCGGCGAGGATT<br>GCGTTGTTGGAGGTTTTCACGTGCCTGCTGGTACGAGACTATGGGCT | | |

TABLE 1-continued

Example amino acid sequences of DRS-DRR enzymes, split DRS and DRR enzymes, and other nucleotide sequences.

| Sequence | Description | SEQ. ID NO. |
|---|---|---|
| AACGTTTGGAAGATGCAAAGAGATCCCAAAGTTTGGGACGATCCTCT<br>AGTATTCAGACCTGAAAGGTTTTTGAGCGACGAGCAAAAGATGGTA<br>GACGTTCGTGGCCAAAACTATGAACTTCTGCCATTCGGCGCAGGAAG<br>AAGAATCTGTCCAGGCGTTTCCTTTAGTCTTGACCTTATGCAACTTGT<br>CCTAACCAGGTTAATCCTAGAGTTCGAAATGAAGTCCCCGTCCGGCA<br>AGGTAGATATGACCGCAACTCCAGGACTAATGTCTTACAAGGTGGTT<br>CCATTGGACATATTGCTGACTCACCGTCGTATCAAGTCATGCGTTCA<br>ATTGGCGTCTTCTGAACGTGATtaaGCGAATTTCTTATGATTTATGATT<br>TTTATTATTAAATAAGTTATAAAAAAAATAAGTGTATACAAATTTTA<br>AAGTGACTCTTAGGTTTTAAAACGAAAATTCTTATTCTTGAGTAACT<br>CTTTCCTGTAGGTCAGGTTGCTTTCTCAGGTATTCAGTTCGAGTTTAT<br>CATTATCAATACTGCCATTTCAAAGAATACGTAAATAATTAATAGTA<br>GTGATTTTCCTAACTTTATTTAGTCAAAAAATTAGCCTTTTAATTCTG<br>CTGTAACCCGTACATGCCCAAAATAGGGGCGGGTTACACAGAATA<br>TATAACATCGTAGGTGTCTGGGTGAACAGTTTATTCCTGGCATCCAC<br>TAAATATAATGGAGCCCGCTTTTTAAGCTGGCATCCAGAAAAAAAA<br>AGAATCCCAGCACCAAAATATTGTTTTCTTCACCAACCATCAGTTCA<br>TAGGTCCATTCTCTTAGCGCAACTACAGAGAACAGGGGCACAAACA<br>GGCAAAAAACGGGCACAACCTCAATGGAGTGATGCAACCTGCCTGG<br>AGTAAATGATGACACAAGGCAATTGACCCACGCATGTATCTATCTCA<br>TTTTCTTACACCTTCTATTACCTTCTGCTCTCTCTGATTTGGAAAAAG<br>CTGAAAAAAAAGGTTGAAACCAGTTCCCTGAAATTATTCCCCTACTT<br>GACTAATAAGTATATAAAGACGGTAGGTATTGATTGTAATTCTGTAA<br>ATCTATTTCTTAAACTTCTTAAATTCTACTTTTATAGTTAGTCTTTTTT<br>TTAGTTTTAAAACACCAAGAACTTAGTTTCGAATAAACACACATAAA<br>CAAACAAATGGAAAGTTCTGGGGTGCCTGTGATCACATTGTCCTCA<br>GGTAAAGTAATGCCCGTACTGGGCATGGGAACCTTCGAAAAGGTGG<br>GTAAGGGGTCTGAACGTGAGCGTTTAGCCATTCTTAAAGCGATCGAA<br>GTTGGTTACCGTTACTTTGATACCGCAGCGGCATATGAAACGGAAGA<br>AGTTCTAGGGGAAGCCATTGCTGAAGCTTTACAATTGGGTCTGATAG<br>AGAGCCGTGACGAGCTGTTCATCAGCTCAATGCTTTGGTGCACCGAC<br>GCACATCCAGACCGTGTGCTACTTGCTCTGCAAAACAGTCTGAGAAA<br>TCTAAAACTTGAATATCTAGACCTATATATGTTGCCGTTTCCTGCCAG<br>CCTTAAGCCGGGCAAAATTACGATGGATATTCCTGAGGAGGATATTT<br>GCCGTATGGATTATCGTTCAGTCTGGAGCGCCATGGAAGAGTGTCAA<br>AACTTAGGATTTACTAAAAGTATTGGTGTAAGCAACTTTTCTTGCAA<br>GAAATTACAAGAATTAATGGCCACTGCAAATATCCCGCCCGCGGTA<br>AATCAAGTAGAGATGTCACCAGCTTTCCAACAGAAAAAACTGAGGG<br>AATATTGTAACGCAAACAACATATTGGTATCCGCAGTAAGCATTCTG<br>GGATCAAACGGGACGCCCTGGGGTAGTAATGCTGTTCTTGGAAGCG<br>AAGTTTTGAAACAGATCGCGATGGCGAAAGGCAAAAGCGTTGCGCA<br>AGTCAGTATGAGGTGGGTCTATGAGCAGGGCGCGTCTTTAGTAGTCA<br>AGAGTTTCTCTGAAGAACGTTTAAGAGAAAACCTGAATATTTTTGAC<br>TGGGAGCTTACGAAAGAAGACAATGAGAAGATAGGCGAAATCCCGC<br>AATGTAGAATCCTTACTGCGTACTTCCTTGTCTCCCCGAACGGCCCGT<br>TTAAATCTCAGGAAGAGCTTTGGGATGACAAGGCAtaaACAGGCCCCT<br>TTTCCTTTGTCGATATCATGTAATTAGTTATGTCACGCTTACATTCAC<br>GCCCTCCTCCCACATCCGCTCTAACCGAAAAGGAAGGAGTTAGACA<br>ACCTGAAGTCTAGGTCCCTATTTATTTTTTTAATAGTTATGTTAGTA<br>TTAAGAACGTTATTTATATTTCAAATTTTTCTTTTTTTTCTGTACAAAC<br>GCGTGTACGCATGTAACATTATACTGAAAACCTTGCTTGAGAAGGTT<br>TTGGGACGCTCGAAGGCTTTAATTTGTAATCATTATCACTTTACGGGT<br>CCTTTCCGGTGATCCGACAGGTTACGGGGCGGCGACCTCGCGGGTTT<br>TCGCTATTTATGAAAATTTTCCGGTTTAAGGCGTTTCCGTTCTTCTTC<br>GTCATAACTTAATGTTTTTATTTAAAATACCTCGCGAGTGGCAACAC<br>TGAAAATACCCATGGAGCGGCGTAACCGTCGCACAGgatctaggtgaagatcc<br>ttttgataatctcatgaccaaaatcccttaacgtgagttttcgttccactgagcgtcagacccgtagaaaaga<br>tcaaaggatcttcttgagatcctttttttctgcgcgtaatctgctgcttgcaaacaaaaaaaccaccgctaccag<br>cggtggtttgtttgccggatcaagagctaccaactctttttccgaaggtaactggcttcagcagagcgcagatac<br>caaatactgtccttctagtgtagccgtagttaggccaccacttcaagaactctgtagcaccgcctacatacctcg<br>ctctgctaatcctgttaccagtggctgctgccagtggcgataagtcgtgtcttaccgggttggactcaagacgat<br>agttaccggataaggcgcagcggtcgggctgaacggggggttcgtgcacacagcccagcttggagcgaacgacct<br>acaccgaactgagatacctacagcgtgagctatgagaaagcgccacgcttcccgaagggagaaaggcggacaggt<br>atccggtaagcggcagggtcggaacaggagagcgcacgagggagcttccaggggaaacgcctggtatctttat<br>agtccgtcgggtttcgccacctctgacttgagcgtcgatttttgtgatgctcgtcaggggcggagcctatgg<br>aaaaacgccagcaacgcggccttggaacgTGCATTATGAATTAGTTACGCTAGGGATAACAG<br>GGTAATATAGAACCCGAACGACCGAGCGCAGCGGCGGCCGCGCTGA<br>TACCGCCGC | | |
| CCTCGCCGCAGTTAATTAAAGTCAGTGAGCGAGGAAGCGCGTAACT<br>ATAACGGTCCTAAGGTAGCGAATCCTGATGCGGTATTTTCTCCTTAC<br>GCATCTGTGCGGTATTTCACACCGCATAGATCGGCAAGTGCACAAAC<br>AATACTTAAATAAATACTACTCAGTAATAACCTATTTCTTAGCATTTT<br>TGACGAAATTTGCTATTTTGTTAGAGTCTTTTACACCATTTGTCTCCA | pJL35 | SEQ. ID NO. 29 |

TABLE 1-continued

Example amino acid sequences of DRS-DRR enzymes, split DRS and DRR enzymes, and other nucleotide sequences.

| Sequence | Description | SEQ. ID NO. |
|---|---|---|
| CACCTCCGCTTACATCAACACCAATAACGCCATTTAATCTAAGCGCA<br>TCACCAACATTTTCTGGCGTCAGTCCACCAGCTAACATAAAATGTAA<br>GCTTTCGGGGCTCTCTTGCCTTCCAACCCAGTCAGAAATCGAGTTCC<br>AATCCAAAAGTTCACCTGTCCCACCTGCTTCTGAATCAAACAAGGGA<br>ATAAACGAATGAGGTTTCTGTGAAGCTGCACTGAGTAGTATGTTGCA<br>GTCTTTTGGAAATACGAGTCTTTTAATAACTGGCAAACCGAGGAACT<br>CTTGGTATTCTTGCCACGACTCATCTCCATGCAGTTGGACGATATCA<br>ATGCCGTAATCATTGACCAGAGCCAAAACATCCTCCTTAAGTTGATT<br>ACGAAACACGCCAACCAAGTATTTCGGAGTGCCTGAACTATTTTTAT<br>ATGCTTTTACAAGACTTGAAATTTTCCTTGCAATAACCGGGTCAATT<br>GTTCTCTTTCTATTGGGCACACATATAATACCCAGCAAGTCAGCATC<br>GGAATCTAGAGCACATTCTGCGGCCTCTGTGCTCTGCAAGCCGCAAA<br>CTTTCACCAATGGACCAGAACTACCTGTGAAATTAATAACAGACATA<br>CTCCAAGCTGCCTTTGTGTGCTTAATCACGTATACTCACGTGCTCAAT<br>AGTCACCAATGCCCTCCCTCTTGGCCCTCTCCTTTTCTTTTTTCGACC<br>GAATTAATTCTTAATCGGCAAAAAAAGAAAAGCTCCGGATCAAGAT<br>TGTACGTAAGGTGACAAGCTATTTTTCAATAAAGAATATCTTCCACT<br>ACTGCCATCTGGCGTCATAACTGCAAAGTACACATATATTACGATGC<br>TGTTCTATTAAATGCTTCCTATATTATATATATAGTAATGCTGTGATC<br>TATGGTGCACTCTCAGTACAATCTGCTCTGATGCCGCATAGTTAAGC<br>CAGCCCCGACACCCGCCAACACCCGCTGACGCGCCCTGACGGGCTTG<br>TCTGCTCCCGGCATCCGCTTACAGACAAGCTGTGACCGTCTCCGGGA<br>GCTGCATGTGTCAGAGGTTTTCACCGTCATCACCGAAACGCGCGAGA<br>CGAAAGGGCCTCGTGATACGCCTATTTTTATAGGTTAATGTCATGAT<br>AATAATGGTTTCTTAGACGGATCGCTTGCCTGTAACTTACACGCGCC<br>TCGTATCTTTTAATGATGGAATAATTTGGGAATTTACTCTGTGTTTAT<br>TTATTTTTATGTTTTGTATTTGGATTTTAGAAAGTAAATAAAGAAGGT<br>AGAAGAGTTACGGAATGAAGAAAAAAAAATAAACAAAGGTTTAAA<br>AAATTTCAACAAAAAGCGTACTTTACATATATATTTATTAGACAAGA<br>AAAGCAGATTAAATAGATATACATTCGATTAACGATAAGTAAAATG<br>TAAAATCACAGGATTTTCGTGTGTGGTCTTCTACACAGACAAGGTGA<br>AACAATTCGGCATTAATACCTGAGAGCAGGAAGAGCAAGATAAAAG<br>GTAGTATTTGTTGGCGATCCCCCTAGAGTCTTTTACATCTTCGGAAAA<br>CAAAAACTATTTTTCTTTAATTTCTTTTTTTACTTTCTATTTTTAATTT<br>ATATATTTATATTAAAAAATTTAAATTATAATTATTTTTATAGCACGT<br>GATGAAAAGGACCCAGGTGGCACTTTTCGGGGAAATGTGCGCGGAA<br>CCCCTATTTGTTTATTTTTCTAAATACATTCAAATATGTATCCGCTCA<br>TGAGACAATAACCCTGATAAATGCTTCAATAATATTGAAAAAGGAA<br>GAGTATGAGTATTCAACATTTCCGTGTCGCCCTTATTCCCTTTTTTGC<br>GGCATTTTGCCTTCCTGTTTTGCTCACCCAGAAACGCTGGTGAAAGT<br>AAAAGATGCTGAAGATCAGTTGGGACGCGTAGTCTAGACCAGCCAG<br>GACAGAAATGCCTCGACTTCGCTGCTACCCAAGGTTGCCGGGTGACG<br>CACACCGTGGAAACGGATGAAGGCACGAACCCAGTGGACATAAGCC<br>TGTTCGGTTCGTAAGCTGTAATGCAAGTAGCGTATGCGCTCACGCAA<br>CTGGTCCAGAACCTTGACCGAACGCAGCGGTGGTAACGGCGCAGTG<br>GCGGTTTTCATGGCTTGTTATGACTGTTTTTTTGGGGTACAGTCTATG<br>CCTCGGGCATCCAAGCAGCAAGCGCGTTACGCCGTGGGTCGATGTTT<br>GATGTTATGGAGCAGCAACGATGTTACGCAGCAGGGCAGTCGCCCT<br>AAAACAAAGTTAAACATTATGAGGGAAGCGGTGATCGCCGAAGTAT<br>CGACTCAACTATCAGAGGTAGTTGGCGCCATCGAGCGCCATCTCGAA<br>CCGACGTTGCTGGCCGTACATTTGTACGGCTCCGCAGTGGATGGCGG<br>CCTGAAGCCACACAGTGATATTGATTTGCTGGTTACGGTGACCGTAA<br>GGCTTGATGAAACAACGCGGCGAGCTTTGATCAACGACCTTTTGGAA<br>ACTTCGGCTTCCCCTGGAGAGAGCGAGATTCTCCGCGCTGTAGAAGT<br>CACCATTGTTGTGCACGACGACATCATTCCGTGGCGTTATCCAGCTA<br>AGCGCGAACTGCAATTTGGAGAATGGCAGCGCAATGACATTCTTGC<br>AGGTATCTTCGAGCCAGCCACGATCGACATTGATCTGGCTATCTTGC<br>TGACAAAAGCAAGAGAACATAGCGTTGCCTTGGTAGGTCCAGCGGC<br>GGAGGAACTCTTTGATCCGGTTCCTGAACAGGATCTATTTGAGGCGC<br>TAAATGAAACCTTAACGCTATGGAACTCGCCGCCCGACTGGGCTGGC<br>GATGAGCGAAATGTAGTGCTTACGTTGTCCCGCATTTGGTACAGCGC<br>AGTAACCGGCAAAATCGCGCCGAAGGATGTCGCTGCCGGCTGGGCA<br>ATGGAGCGCCTGCCGGCCCAGTATCAGCCCGTCATACTTGAAGCTAG<br>ACAGGCTTATCTTGGACAAGAAGAAGATCGCTTGGCCTCGCGCGCA<br>GATCAGTTGGAAGAATTTGTCCACTACGTGAAAGGCGAGATCACCA<br>AGGTAGTCGGCAAATAACCCTCGAGCATTCAAGGCGCCTTGATTATT<br>TGACGTGGTTTGATGGCCTCCACGCACGTTGTGATATGTAGATGATT<br>CAGTTCGAGTTTATCATTATCAATACTGCCATTTCAAAGAATACGTA<br>AATAATTAATAGTAGTTTCCTAACTTTATTTAGTCAAAAAATTA<br>GCCTTTTAATTCTGCTGTAACCCGTACATGCCCAAAATAGGGGCGG<br>GTTACACAGAATATATAACATCGTAGGTGTCTGGGTGAACAGTTTAT<br>TCCTGGCATCCACTAAATATAATGGAGCCCGCTTTTAAGCTGGCAT<br>CCAGAAAAAAAAGAATCCCAGCACCAAAATATTGTTTTCTTCACCA<br>ACCATCAGTTCATAGGTCCATTCTCTTAGCGCAACTACAGAGAACAG | | |

TABLE 1-continued

Example amino acid sequences of DRS-DRR enzymes, split DRS and DRR enzymes, and other nucleotide sequences.

| Sequence | Description | SEQ. ID NO. |
|---|---|---|
| GGGCACAAACAGGCAAAAAACGGGCACAACCTCAATGGAGTGATGC<br>AACCTGCCTGGAGTAAATGATGACACAAGGCAATTGACCCACGCAT<br>GTATCTATCTCATTTTCTTACACCTTCTATTACCTTCTGCTCTCTGA<br>TTTGGAAAAAGCTGAAAAAAAAGGTTGAAACCAGTTCCCTGAAATT<br>ATTCCCCTACTTGACTAATAAGTATATAAAGACGGTAGGTATTGATT<br>GTAATTCTGTAAATCTATTTCTTAAACTTCTTAAATTCTACTTTTATA<br>GTTAGTCTTTTTTTTAGTTTTAAAACACCAAGAACTTAGTTTCGAATA<br>AACACACATAAACAAACAAAATGGAACTTCAGTACTTCTCCTATTTT<br>CAACCCACTTCATCTGTCGTAGCCCTACTACTAGCACTAGTGAGTAT<br>TTTATTTAGCGTAGTTGTTTTGAGGAAGACTTTCAGTAACAATTACTC<br>CAGCCCCGCGTCAAGTACGGAAACCGCTGTGCTGTGTCATCAGAGGC<br>AACAGAGTTGCGCCCTACCTATCAGCGGCCTTCTTCACGTGTTCATG<br>AATAAGAACGGCCTGATTCATGTCACCTTGGGAAATATGGCTGACAA<br>ATATGGCCCTATCTTCAGTTTTCCGACAGGCAGCCACCGTACTTTAGT<br>AGTCAGTTCCTGGGAAATGGTGAAAGAGTGTTTCACCGGTAATAACG<br>ACACGGCATTCTCCAACAGACCAATCCCTTTGGCTTTTCAAACCATA<br>TTCTACGCCTGTGGCGGCATTGATTCTTACGGTTTAAGTAGTGTCCCG<br>TATGGTAAATACTGGAGGGAGTTGAGAAAGGTGTGTGTTCACAACCT<br>GCTGAGTAATCAGCAATTGCTGAAGTTCAGACATCTTATAATCTCCC<br>AAGTGGATACGTCTTTTAACAAGTTGTATGAGCTGTGTAAGAACTCT<br>GAAGATAATCAAGGTATGGTAAGGATGGATGATTGGCTAGCTCAAC<br>TTTCCTTTAACGTCATCGGTAGGATCGTTTGCGGATTCCAGTCTGACC<br>CAAAGACGGGTGCACCTTCAAGGGTAGAACAGTTTAAGGAAGTCAT<br>AAATGAGGCGTCATATTTTATGTCAACAAGTCCAGTCTCCGATAACG<br>TACCAATGTTGGGATGGATCGACCAATTGACCGGTCTGACGAGGAA<br>CATGAAGCATTGTGGGAAGAAGCTTGACTTAGTAGTGGAGTCAATTA<br>TCAAGGACCATAGGCAAAAGAGACGTTTTTCACGTACAAAAGGTGG<br>CGATGAGAAGGATGACGAACAGGACGACTTTATTGATATTTGCTTGA<br>GCATCATGGAGCAGCCACAGTTGCCCGGGAACAATTCTCCCCCTCAA<br>ATTCCGATCAAATCTATCGTGCTAGACATGATTGGGGGTGGTACCGA<br>CACTACGAAACTTACAACCATATGGACCCTATCACTTTTGTTGAACA<br>ATCCTCACGTGTTAGATAAAGCTAAACAAGAGGTCGACGCTCACTTT<br>CGTAAAAAGAGAAGATCAACAGATGACGCAGCAGCGGCAGTCGTTG<br>ATTTTGACGACATAAGAAATTTAGTATACATCCAAGCCATCATTAAA<br>GAAAGTATGAGGCTTTATCCAGCCAGCCCGGTGGTTGAGCGTCTTTC<br>CGGCGAGGATTGCGTTGTTGGAGGTTTTCACGTGCCTGCTGGTACGA<br>GACTATGGGCTAACGTTTGGAAGATGCAAAGAGATCCCAAAGTTTG<br>GGACGATCCTCTAGTATTCAGACCTGAAAGGTTTTTGAGCGACGAGC<br>AAAAGATGGTAGACGTTCGTGGCCAAAACTATGAACTTCTGCCATTC<br>GGCGCAGGAAGAAGAATCTGTCCAGGCGTTTCCTTTAGTCTTGACCT<br>TATGCAACTTGTCCTAACCAGGTTAATCCTAGAGTTCGAAATGAAGT<br>CCCCGTCCGGCAAGGTAGATATGACCGCAACTCCAGGACTAATGTCT<br>TACAAGGTGGTTCCATTGGACATATTGCTGACTCACCGTCGTATCAA<br>GTCATGCGTTCAATTGGCGTCTTCTGAACGTGATtaaGCGAATTTCTTA<br>TGATTTATGATTTTTATTATTAAATAAGTTATAAAAAAAATAAGTGT<br>ATACAAATTTTAAAGTGACTCTTAGGTTTTAAAACGAAAATTCTTAT<br>TCTTGAGTAACTCTTTCCTGTAGGTCAGGTTGCTTTCTCAGGTAGAGC<br>GTTGGTTGGTGGATCAAGCCCACGCGTAGGCAATCCTCGAGCAGATC<br>CGCCAGGCGTGTATATATAGCGTGGATGGCCAGGCAACTTTAGTGCT<br>GACACATACAGGCATATATATATGTGTGCGACAACACATGATCATAT<br>GGCATGCATGTGCTCTGTATGTATATAAAACTCTTGTTTTCTTCTTTT<br>CTCTAAATATTCTTTCCTTATACATTAGGACCTTTGCAGCATAAATTA<br>CTATACTTCTATAGACACACAAACACAAATACACACACTAAATTAAT<br>AATGGAAAGTTCTGGGGTGCCTGTGATCACATTGTCCTCAGGTAAAG<br>TAATGCCCGTACTGGGCATGGGAACCTTCGAAAAGGTGGGTAAGGG<br>GTCTGAACGTGAGCGTTTAGCCATTCTTAAAGCGATCGAAGTTGGTT<br>ACCGTTACTTTGATACCGCAGCGGCATATGAAACGGAAGAAGTTCTA<br>GGGGAAGCCATTGCTGAAGCTTTACAATTGGGTCTGATAGAGAGCC<br>GTGACGAGCTGTTCATCAGCTCAATGCTTTGGTGCACCGACGCACAT<br>CCAGACCGTGTGCTACTTGCTCTGCAAAACAGTCTGAGAAATCTAAA<br>ACTTGAATATCTAGACCTATATATGTTGCCGTTTCCTGCCAGCCTTAA<br>GCCGGGCAAAATTACGATGGATATTCCTGAGGAGGATATTTGCCGTA<br>TGGATTATCGTTCAGTCTGGAGCGCCATGGAAGAGTGTCAAAACTTA<br>GGATTTACTAAAAGTATTGGTGTAAGCAACTTTTCTTGCAAGAAATT<br>ACAAGATTAATGGCCACTGCAAATATCCCGCCCGCGGTAAATCAA<br>GTAGAGATGTCACCAGCTTTCCAACAGAAAAAACTGAGGGAATATT<br>GTAACGCAAACAACATATTGGTATCCGCAGTAAGCATTCTGGGATCA<br>AACGGGACGCCCTGGGGTAGTAATGCTGTTCTTGGAAGCGAAGTTTT<br>GAAACAGATCGCGATGGCGAAAGGCAAAAGCGTTGCGCAAGTCAGT<br>ATGAGGTGGGTCTATGAGCAGGGCGCGTCTTTAGTAGTCAAGAGTTT<br>CTCTGAAGAACGTTTAAGAGAAAACCTGAATATTTTTGACTGGGAGC<br>TTACGAAAGAAGACAATGAGAAGATAGGCGAAATCCCGCAATGTAG<br>AATCCTTACTGCGTACTTCCTTGTCTCCCCGAACGGCCCGTTTAAATC<br>TCAGGAAGAGCTTTGGGATGACAAGGCAtaaACAGGCCCCITTTCCTT | | |

TABLE 1-continued

Example amino acid sequences of DRS-DRR enzymes, split DRS and DRR enzymes, and other nucleotide sequences.

| Sequence | Description | SEQ. ID NO. |
|---|---|---|

TGTCGATATCATGTAATTAGTTATGTCACGCTTACATTCACGCCCTCC
TCCCACATCCGCTCTAACCGAAAAGGAAGGAGTTAGACAACCTGAA
GTCTAGGTCCCTATTTATTTTTTTAATAGTTATGTTAGTATTAAGAA
CGTTATTTATATTTCAAATTTTTCTTTTTTTTCTGTACAAACGCGTGTA
CGCATGTAACATTATACTGAAAACCTTGCTTGAGAAGGTTTTGGGAC
GCTCGAAGGCTTTAATTTGTAATCATTATCACTTTACGGGTCCTTTCC
GGTGATCCGACAGGTTACGGGGCGGCGACCTCGCGGGTTTTCGCTAT
TTATGAAAATTTTCCGGTTTAAGGCGTTTCCGTTCTTCTTCGTCATAA
CTTAATGTTTTTATTTAAAATACCTCGCGAGTGGCAACACTGAAAAT
ACCCATGGAGCGGCGTAACCGTCGCACAGgatctaggtgaagatcctttttgataatctc
atgaccaaaatcccttaacgtgagttttcgttccactgagcgtcagaccccgtagaaaagatcaaaggatcttctt
gagatccttttttctgcgcgtaatctgctgcttgcaaacaaaaaaaccaccgctaccagcggtggtttgtttgc
cggatcaagagctaccaactcttttccgaaggtaactggcttcagcagagcgcagataccaaatactgtccttc
tagtgtagccgtagttaggccaccacttcaagaactctgtagcaccgcctacatacctcgctctgctaatcctgt
taccagtggctgctgccagtggcgataagtcgtgtcttaccgggttggactcaagacgatagttaccggataagg
cgcagcggtcgggctgaacgggggggttcgtgcacacagcccagcttggagcgaacgacctacaccgaactgagat
acctacagcgtgagctatgagaaagcgccacgcttcccgaagggagaaaggcggacaggtatccggtaagcggca
gggtcggaacaggagagcgcacgagggagcttccaggggaaacgcctggtatctttatagtcctgtcgggtttc
gccacctctgacttgagcgtcgatttttgtgatgctcgtcagggggcggagcctatggaaaaacgccagcaacg
cggcagtggaacgTGCATTATGAATTAGTTACGCTAGGGATAACAGGGTAATATAG
AACCCGAACGACCGAGCGCAGCGGCGGCCGCGCTGATACCGCCGC

Morphinan Alkaloid Generating Modifications

Figure 28:
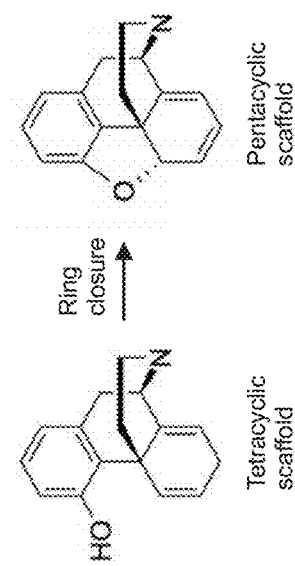
FIG. 28 illustrates the general ring closure reaction converting a tetracyclic scaffold to a pentacyclic scaffold, in accordance with embodiments of the invention.

Some methods, processes, and systems provided herein describe the conversion of promorphinan alkaloids to morphinan alkaloids. Some of the methods, processes, and systems describe the conversion of a tetracyclic scaffold to a pentacyclic scaffold (FIG. 28). Some of the methods, processes, and systems may comprise an engineered host cell. In some examples, the production of pentacyclic thebaine, or a morphinan alkaloid, from a tetracyclic precursor, or a promorphinan alkaloid is described. In some examples, the conversion of promorphinan alkaloids to thebaine are key steps in the conversion of a substrate to a diverse range of benzylisoquinoline alkaloids.

In some examples, the tetracyclic precursor may be salutaridine, salutaridinol, or salutaridinol-7-O-acetate. The tetracyclic precursor may be converted to pentacyclic thebaine by closure of an oxide bridge between C-4 and C-5. In some examples, the tetracyclic precursor salutaridine may be prepared for ring closure by stepwise hydroxylation and O-acetylation at C-7. Ring closure may be activated by elimination of an acetate leaving group. In some examples, the allylic elimination and oxide ring closure that generates thebaine occurs spontaneously. In other examples, the ring closure reaction that generates pentacyclic thebaine is promoted by factors such as pH or solvent. In other examples, the thebaine-generating ring closure reaction is promoted by contact with a protein or enzyme. These conversion steps are provided in FIG. 14 and represented generally in Scheme 2. $R_1$, $R_2$, and $R_3$ may be H or $CH_3$. $R_4$ may be $CH_3$, $CH_3CH_2$, $CH_3CH_2CH_2$, or other appropriate alkyl group. In some cases, $R_1$, $R_2$, $R_3$, and $R_4$ may be $CH_3$ as provided in FIG. 14.

Scheme 2

Precursor →

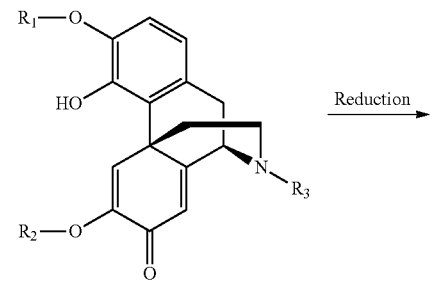

Reduction →

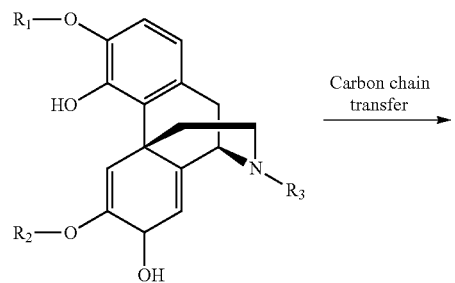

Carbon chain transfer →

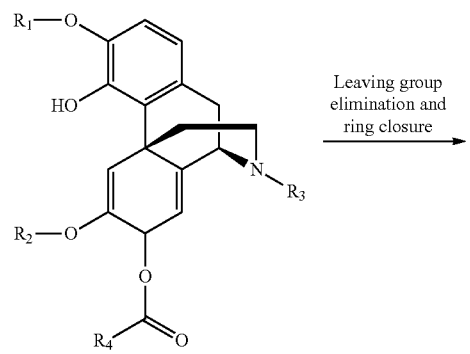

Leaving group elimination and ring closure →

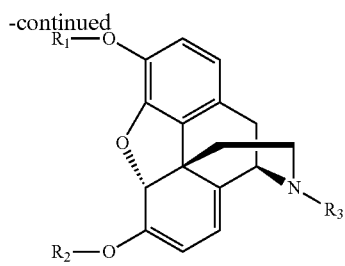

In some examples, the first enzyme that prepares the tetracyclic precursor is salutaridine reductase (SalR). In some cases, SalR hydroxylates the substrate salutaridine at the C-7 position (see Formula III). The product of this reaction may be one or more salutaridinol epimers. In some examples, the product is (7S)-salutaridinol. In some examples, the salutaridine reductase may catalyze the reduction reaction within a host cell, such as an engineered host, as described herein.

In some examples, the second enzyme that prepares the tetracyclic precursor is salutaridinol 7-O-acetyltransferase (SalAT). In some cases, SalAT transfers the acetyl from acetyl-CoA to the 7-OH of salutaridinol (see Formula IV). In other cases, SalAT may utilize a novel cofactor such as n-propionyl-CoA and transfer the propionyl to the 7-OH of salutaridinol. In some examples, the product of SalAT is (7S)-salutaridinol-7-O-acetate. In some examples, the salutaridinol 7-O-acetyltransferase may catalyze the acetyl transfer reaction within a host cell, such as an engineered host, as described herein.

In some examples, the tetracyclic precursor of thebaine is (7S)-salutaridinol-7-O-acetate. In some examples (7S)-salutaridinol-7-O-acetate is unstable and spontaneously eliminates the acetate at C-7 and closes the oxide bridge between C-4 and C-5 to form thebaine (see Formula V). In some examples, the rate of elimination of the acetate leaving group is promoted by pH. In some examples, the allylic elimination and oxide bridge closure is catalyzed by an enzyme with thebaine synthase activity, or a thebaine synthase. In some examples, this enzyme is a Bet v 1-fold protein. In some examples, this enzyme is an engineered thebaine synthase, an engineered SalAT, a dirigent (DIR) protein, or a chalcone isomerase (CHI). In some examples, the enzyme encoding thebaine synthase activity may catalyze the ring closure reaction within a host cell, such as an engineered host, as described herein.

In some examples, the salutaridine reductase enzyme may be SalR or a SalR-like enzyme from plants in the Ranunculales order that biosynthesize thebaine, for example *Papaver somniferum*. In other examples, the enzyme with salutaridine reductase activity may be from mammals or any other vertebrate or invertebrate that biosynthesizes endogenous morphine.

In some examples, the salutaridinol 7-O-acetyltransferase enzyme may be SalAT or a SalAT-like enzyme from plants in the Ranunculales order that biosynthesize thebaine, for example *P. somniferum*. In other examples, the enzyme with salutaridinol 7-O-acetyltransferase activity may be from mammals or any other vertebrate or invertebrate that biosynthesizes endogenous morphine.

In some examples, the thebaine synthase enzyme may be a Bet v 1 fold protein from plants in the Ranunculales order that biosynthesize thebaine, for example *P. somniferum*. In some examples, the Bet v 1 protein includes the following domains in order from the N-terminus to C-terminus: a β-strand, one or two α-helices, six β-strands, and one or two α-helices. The protein is organized such that it has a Bet v 1 fold and an active site that accepts large, bulky, hydrophobic molecules, such as morphinan alkaloids. This protein may be any plant Bet v 1 protein, pathogenesis-related 10 protein (PR-10), a major latex protein (MLP), fruit or pollen allergen, plant hormone binding protein (e.g., binding to cytokinin or brassinosteroids), plant polyketide cyclase-like protein, or norcoclaurine synthase (NCS)-related protein that has a Bet v 1 fold. Other non-plant examples of the Bet v 1 fold protein are polyketide cyclases, activator of Hsp90 ATPase homolog 1 (AHA1) proteins, SMU440-like proteins (e.g., from *Streptococcus mutans*), PA1206-related proteins (e.g., from *Pseudomonas aeruginosa*), CalC calicheamicin resistance protein (e.g., from *Micromonospora echinospora*), and the CoxG protein from carbon monoxide metabolizing *Oligotropha carboxidovorans*. Further examples from Bet v 1-related families include START lipid transfer proteins, phosphatidylinositol transfer proteins, and ring hydroxylases.

In some examples, the thebaine synthase enzyme may be a dirigent protein from plants in the Ranunculales order that biosynthesize thebaine, for example *P. somniferum*. In other examples, the enzyme may be any dirigent protein from plants.

In some examples, the thebaine synthase enzyme may be a chalcone isomerase protein from plants in the Ranunculales order that biosynthesize thebaine, for example *P. somniferum*. In other examples, the enzyme may be any chalcone isomerase protein from plants.

In some examples, the thebaine synthase enzyme may be a SalAT-like enzyme from plants in the Ranunculales order that biosynthesize thebaine, for example *P. somniferum*. In other examples, the enzyme may be any SalAT-like protein from plants.

In some examples, the enzyme with thebaine synthase activity may be from mammals or any other vertebrate or invertebrate that biosynthesizes endogenous morphine.

In some examples, any combination of the above enzymes together with additional accessory proteins may function to convert any tetracyclic precursor into thebaine. In some examples, these enzymes catalyze the reactions within a host cell, such as an engineered host, as described herein.

Examples of amino acid sequences for thebaine synthase activity are set forth in Table 2. An amino acid sequence for a thebaine synthase that is utilized in a tetracyclic precursor to thebaine may be 75% or more identical to a given amino acid sequence as listed in Table 2. For example, an amino acid sequence for such a thebaine synthase may comprise an amino acid sequence that is at least 75% or more, 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more, or 99% or more identical to an amino acid sequence as provided herein. Additionally, in certain embodiments, an "identical" amino acid sequence contains at least 80%-99% identity at the amino acid level to the specific amino acid sequence. In some cases an "identical" amino acid sequence contains at least about 85%, 86%, 87%, 88%, 89%, 90%, 91%, 92%, 93%, 94% and more in certain cases, at least 95%, 96%, 97%, 98% and 99% identity, at the amino acid level. In some cases, the amino acid sequence may be identical but the DNA sequence is altered such as to optimize codon usage for the host organism, for example.

An engineered host cell may be provided that produces a salutaridine reductase, salutaridinol 7-O-acetyltransferase, and thebaine synthase that converts a tetracyclic precursor into thebaine, wherein the thebaine synthase comprises an amino acid sequence selected from the group consisting of SEQ ID NOs: 30, 31, 32, 33, 34, 35, 36, and 37. In some cases, the thebaine synthase may form a fusion protein with other enzymes. The enzymes that are produced within the engineered host cell may be recovered and purified so as to form a biocatalyst. These one or more enzymes may also be used to catalyze the conversion of a tetracyclic promorphinan precursor to thebaine.

In other examples, the thebaine synthase comprises an amino acid sequence selected from the group consisting of SEQ ID NOs: 38, 39, 40, 41, 42, 43, 44, 45, 46, 47, 48, 49, 50, 51, 52, 53, 54, 55, 56, 57, 58, 59, 60, and 61.

In additional cases, the one or more enzymes that are recovered from the engineered host cell may be used in a process for converting a tetracyclic promorphinan precursor to a thebaine. The process may include contacting the tetracyclic promorphinan precursor with the recovered enzymes in an amount sufficient to convert said tetracyclic promorphinan precursor to thebaine. In examples, the tetracyclic promorphinan precursor may be contacted with a sufficient amount of the one or more enzymes such that at least 5% of said tetracyclic promorphinan precursor is converted to thebaine. In further examples, the tetracyclic promorphinan precursor may be contacted with a sufficient amount of the one or more enzymes such that at least 10%, at least 15%, at least 20%, at least 25%, at least 30%, at least 35%, at least 40%, at least 45%, at least 50%, at least 55%, at least 60%, at least 65%, at least 70%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, at least 99.5%, at least 99.7%, or 100% of said tetracyclic promorphinan precursor is converted to thebaine.

In some examples, process conditions are implemented to support the formation of thebaine in engineered host cells. In some cases, engineered host cells are grown at pH 3.3, and once high cell density is reached the pH is adjusted to pH 8.0 to support continued production of thebaine at higher pH. In some cases, the engineered host cells produce additional enzymes to convert sugar and other simple precursors, such as tyrosine, to thebaine. In some cases, the SalAT enzyme has been engineered to exhibit higher activity at pH 8.0 and is expressed from a late stage promoter.

In some examples, one or more of the enzymes converting a tetracyclic promorphinan precursor to a thebaine are localized to cellular compartments. In some examples, SalR, SalAT, and Bet v 1 may be modified such that they encode targeting sequences that localize them to the endoplasmic reticulum membrane of the engineered host cell. In particular, in certain instances, the host cell may be engineered to increase production of salutaridinol or thebaine or products for which thebaine is a precursor from reticuline or its precursors by localizing Bet v 1 and/or SalR and/or SalAT to organelles in the yeast cell. Bet v 1 and/or SalR and/or SalAT may be localized to the yeast endoplasmic reticulum in order to decrease the spatial distance between Bet v 1 and/or SalR and/or SalAT and CYP2D2 or CYP2D6 or SalSyn or an engineered cytochrome P450 enzyme that catalyzes the conversion of reticuline to salutaridine. By increased production is meant both the production of some amount of the compound of interest where the control has no production of the compound of interest, as well as an increase of 10% or more, such as 50% or more, including 2-fold or more, e.g., 5-fold or more, such as 10-fold or more in situations where the control has some production of the compound of interest.

In other examples, SalAT and Bet v 1 may be co-localized in to a single protein fusion. In some examples, the fusion is created between SalAT and Bet v 1 by one of several methods, including, direct fusion, co-localization to a yeast organelle, or by enzyme co-localization tools such as leucine zippers, protein scaffolds that utilize adaptor domains, or RNA scaffolds that utilize aptamers. Co-localizing the thebaine synthesis enzyme may facilitate substrate channeling between the active sites of the enzymes and limit the diffusion of unstable intermediates such as salutaridinol-7-O-acetate.

In some examples, an engineered salutaridinol 7-O-acetyltransferase (SalAT) enzyme is used in converting a tetracyclic promorphinan precursor to a thebaine. In some examples, a SalAT enzyme is engineered to combine two functions: (1) the transfer of an acyl group from acetyl-CoA to the 7-OH of salutaridinol, and (2) the subsequent elimination of the acetyl group and closure of an oxide bridge between carbons C4 and C5 to form thebaine.

In some examples, an enzyme with salutaridinol 7-O-acetyltransferase activity is fused to a peptide with a Bet v 1 fold. In some examples, salutaridinol 7-O-acetyltransferase enzyme and the Bet v 1 fold protein may be fused in any order from N-terminus to C-terminus, C-terminus to N-terminus, N-terminus to N-terminus, or C-terminus to C-terminus. In some examples, the two protein sequences may be fused directly or fused through a peptide linker region.

In some examples, an enzyme with salutaridinol 7-O-acetyltransferase activity is fused to a peptide with a Bet v 1 fold by circular permutation. In some cases, the N- and C-termini of SalAT are fused and the Bet v 1 sequence is then inserted randomly within this sequence. In some cases, the resulting fusion protein library is screened for thebaine production. In other cases, a circular permutation SalAT library is first screened for activity in the absence of Bet v 1. In other cases, the N- and C-termini of SalAT are fused and the enzyme is digested and blunt end cloned. In other cases, this library of circularly permuted SalAT is screened for salutaridinol 7-O-acetyltransferase activity. In other cases, active variants from the circularly permuted SalAT library are then used to design protein fusions with a peptide with a Bet v 1 fold.

The one or more enzymes that may be used to convert a tetracyclic promorphinan precursor to a thebaine may contact the tetracyclic promorphinan precursor in vitro. Additionally, or alternatively, the one or more enzymes that may be used to convert a tetracyclic promorphinan precursor to thebaine may contact the tetracyclic promorphinan precursor in vivo. Additionally, the one or more enzymes that may be used to convert a tetracyclic promorphinan precursor to thebaine may be provided to a cell having the tetracyclic promorphinan precursor within, or may be produced within an engineered host cell.

In some examples, the methods provide for engineered host cells that produce an alkaloid product, wherein the conversion of a tetracyclic promorphinan precursor to a thebaine may comprise a key step in the production of an alkaloid product. In some examples, the alkaloid product is a thebaine. In still other embodiments, the alkaloid product is derived from a thebaine, including for example, downstream morphinan alkaloids. In another embodiment, a tetracyclic promorphinan precursor is an intermediate toward the product in of the engineered host cell. In still other embodiments, the alkaloid product is selected from the group consisting of morphinan, nor-opioid, or nal-opioid alkaloids.

In some examples, the substrate of the reduction reaction is a compound of Formula III:

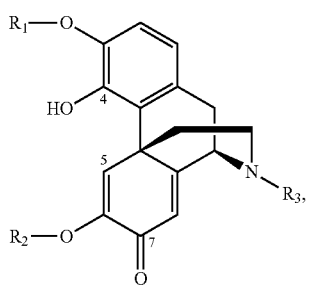

Formula III or a salt thereof, wherein:

$R_1$, $R_2$, and $R_3$ are independently selected from hydrogen and methyl.

In some other examples, $R_1$, $R_2$, and $R_3$ are methyl, and the reduction reaction is catalyzed by a salutaridine reductase.

In some examples, the substrate of the carbon chain transfer reaction is a compound of Formula IV:

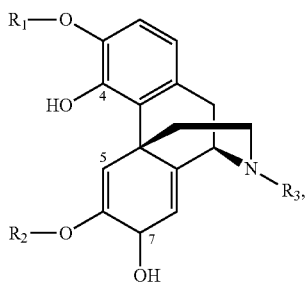

Formula IV or a salt thereof, wherein:

$R_1$, $R_2$, and $R_3$ are independently selected from hydrogen and methyl.

In some other examples, $R_1$, $R_2$, and $R_3$ are methyl, and the carbon chain transfer reaction is catalyzed by a salutaridinol 7-O-acetyltransferase.

In some examples, the substrate of thebaine synthase is a compound of Formula V:

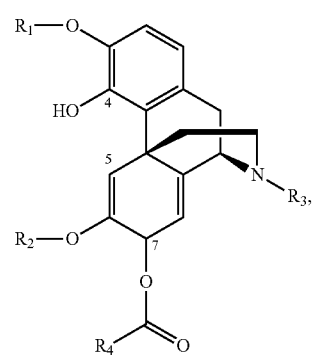

Formula V or a salt thereof, wherein:

$R_1$, $R_2$, and $R_3$ are independently selected from hydrogen and methyl; and $R_4$ is selected from methyl, ethyl, propyl, and other appropriate alkyl group.

In some other examples, $R_1$, $R_2$, $R_3$, and $R_4$ are methyl, and the ring closure reaction is catalyzed by a thebaine synthase. In some examples, the thebaine synthase is a Bet v 1 protein.

In some examples, the methods provide for engineered host cells that produce alkaloid products from salutaridine. The conversion of salutardine to thebaine may comprise a key step in the production of diverse alkaloid products from a precursor. In some examples, the precursor is L-tyrosine or a sugar (e.g., glucose). The diverse alkaloid products can include, without limitation, morphinan, nor-opioid, or nal-opioid alkaloids.

Any suitable carbon source may be used as a precursor toward a pentacyclic morphinan alkaloid. Suitable precursors can include, without limitation, monosaccharides (e.g., glucose, fructose, galactose, xylose), oligosaccharides (e.g., lactose, sucrose, raffinose), polysaccharides (e.g., starch, cellulose), or a combination thereof. In some examples, unpurified mixtures from renewable feedstocks can be used (e.g., cornsteep liquor, sugar beet molasses, barley malt, biomass hydrolysate). In still other embodiments, the carbon precursor can be a one-carbon compound (e.g., methanol, carbon dioxide) or a two-carbon compound (e.g., ethanol). In yet other embodiments, other carbon-containing compounds can be utilized, for example, methylamine, glucosamine, and amino acids (e.g., L-tyrosine). In some examples, a 1-benzylisoquinoline alkaloid may be added directly to an engineered host cell of the invention, including, for example, norlaudanosoline, laudanosoline, norreticuline, and reticuline.

In some examples, the benzylisoquinoline alkaloid product, or a derivative thereof, is recovered. In some examples, the benzylisoquinoline alkaloid product is recovered from a cell culture. In some examples, the benzylisoquinoline alkaloid product is a morphinan, nor-opioid, or nal-opioid alkaloid.

TABLE 2

Example amino acid sequences of morphinan alkaloid generating enzymes.

| Sequence Name | Description | Sequence | SEQ. ID NO. |
|---|---|---|---|
| Bet v1 | | | |
| | P. bracteatum | MAPRGVSGLVGKLSTELDVNCDAEKYYNMYKNGED VQKAVPHLCMDVKVISGDATRSGCIKEWNVNIDGKTI RSVEETTHNDETKTLRHRVFEGDMMKDYKKFDTIME | SEQ. ID NO. 30 |

TABLE 2-continued

Example amino acid sequences of morphinan alkaloid generating enzymes.

| Sequence Name | Description | Sequence | SEQ. ID NO. |
|---|---|---|---|
| | | VNPKPDGNGCVVTRSIEYEKVNENSPTPFDYLQFGHQ AMEDMNKY | |
| | P. setigerum | MLVGKLSTELEVDCDAEKYYNMYKHGEDVKKALCV DVKVISGDPTRSGCIKEWNVNIDGKTIRSVEETTHNDE TKTLRHRVFEGDMMKDFKKFDTIMVVNPKPDGNGC VVTRSIEYEKTNENSPTPFDYLQFGHQAIEDMNKYL | SEQ. ID. NO. 31 |
| | P. setigerum | MLVGKLSTELEVDCDAEKYYNMYKHGEDKRQCVDV KVISGDPTRSGCIKEWNVNIDGKTIRSVEETTHNDETK TLRHRVFEGDMMKDFKKFDTIMVVNPKPDGNGCVV TRSIEYEKTNENSPTPFDYLQFGHQAIEDMNKY | SEQ. ID. NO. 32 |
| | P. setigerum | MLVGKLSTELEVDCDAEKYYNMYKHGEDVKKAVPH LCVDVKIISGDPTSSGCIKEWNVNIDGKTIRSVEETTH DDETKTLRHRVFEGDVMKDFKKFDTIMVVNPKPDGN GCVVTRSIEYEKTNENSPTPFDYLQFGHQAIEDMNKY L | SEQ. ID. NO. 33 |
| | P. setigerum | MVKIISGDPTSSGCIKEWNVNIDGKTIRSVEETTHDDE TKTLRHRVFEGDVMKDFKKFDTIMVVNPKPDGNGCV VTRSIEYEKTNENSPTPFDYLQFGHQAIEDMNKYL | SEQ. ID. NO. 34 |
| | P. somniferum | MDSINSSIYFCAYFRELIIKLLMAPPGVSGLVGKLSTEL EVNCDAEKYYNMYKHGEDVQKAVPHLCVDVKVISG DPTRSGCIKEWNVNIDGKTIRSVEETTHNDETKTLRHR VFEGDVMKDFKKFDTIMVVNPKPDGNGCVVTRSIEY EKTNDNSPTPFDYLQFGHQAIEDMNKYLRDSE | SEQ. ID. NO. 35 |
| | P. somniferum | MNFFIKDHLYICLVGKLSTELEVDCDAEKYYNMYKH GEDVKKAVPHLCVDVKIISGDPTSSGCIKEWNVNIDG KTIRSVEETTHDDETKTLRHRVFEGDVMKDFKKFDTI MVVNPKPDGNGCVVTRSIEYEKTNENSPTPFDYLQFG HQAIEDMNKYLRDSESN | SEQ. ID. NO. 36 |
| | P. somniferum | MAPLGVSGLVGKLSTELEVDCDAEKYYNMYKHGED VKKAVPHLCVDVKIISGDPTSSGCIKEWNVNIDGKTIR SVEETTHDDETKTLRHRVFEGDVMKDFKKFDTIMVV NPKPDGNGCVVTRSIEYEKTNENSPTPFDYLQFGHQAI EDMNKYLRDSESN | SEQ. ID. NO. 37 |
| SalAT | | | |
| | P. somniferum | MMKVCVSSREKIKPSRPTPGHLKTHKLSFLDQVAARI YVPLLLYYAGNKENVDTDTRCNIIKKSLAETLTKFYIL AGKIVNDEIERFVNCNDDGVDFCVTKVSNCQLFQVIK RPDIFDQVTLFLPFDPCDNEITASGDFLLSVQVNVFED CRGMVIGLCINHKVADASSITTFVNYWATIARGLVLN VDDRQIQDPCFQVQSIFPQKEKGIGFKISSSSIDGTLVT KKFGFEASKLAELKERCKFAGATEDIRGGYKPNRVEA LSTFLWKCFIDIDQAKTKAAAPARVYLASNAVNIRSRI VPQLPTSSFGNMVAITDAIFTVNSNENNGINDPYYPKL VQKFRDAVKRVDGEYIEALQSTDLLLNNVTKLFKHIL NGQTLSISFTSWCRFPFYDTDLLD | SEQ. ID. NO. 38 |
| | P. somniferum | MKVQVISKELIKPSTPTPPRLRNFKLSLLDQLLPPFYVP IIIFYPANDDHESNNNDQCIKANILKKSLSETLTRFYPIA GRIRDKILVECNDEGVHYIEAKVNAVMSDFMSLDVIH QLHPSYITLDDLAEEAQLAVQVTMFDCGGIALSICSSH KIIDGCTSTTFLNSWAATARAPSNPEIVYPTFDAAAIFP AQPSGVQVSTLESDDRLQGENVVTKRFLFSASKITAL RARIAESRSSNILSKYPSRSEAVSALVWKSFMETSRVK VTREHTFSAEASTKPIVRSIANFVVNLRTRLNPPLPNVS FGNIIMDATAESLIIDNGENTLGFVETLDGLISQLRLGV TKMDDEYVRKLREDDVEFLKSLDEASHPSNGEGDGN GERV | SEQ. ID. NO. 39 |
| | P. setigerum | MNDTMKIEVVSKESIKPSYPTPNNLKIHNLSNLDQLIP AFYMDHILYYPSLDSNDSSLGDDEEDKKMIFSASSRH RCDVVKKSLAETLTRYYPLAGRIKDEKSVECNDEGV DYIEARVVGITVSQVIQLASSDIEVMEPFLPYEPYGGT GSAFRRAGIHSNSKPLLKIQVNVFDCGGMVICLSGSH KVIDATSILNFVNDWAATARGGFDTHDDELKVAVVD KPCYIFSSMFPPTSFGNQEEKDTADQAQLVPDRIEIVT KRFVFKDSSIAKLKKKCIHVNTNNGSDHQVDKQEHN | SEQ. ID. NO. 40 |

TABLE 2-continued

Example amino acid sequences of morphinan alkaloid generating enzymes.

| Sequence Name | Description | Sequence | SEQ. ID NO. |
|---|---|---|---|
| | | MQQMPSRIEALTSLIWMCFMDVDRRFRVKQIDDAVS<br>PVNTVNEVSLPKQVQYVAGFAINLRTRTIQPLPTNSFG<br>NMTDTAIAEVTLNLTGSDHFNNEKGIRDQSQNYPELV<br>SKIKDSIKLVDNKHIEAMKRNLAISCNNIKMHQMMKE<br>STFDQNTRELLMFSSWCRFPIYEADFGWGKPSWASIT<br>KLLYKNCVMFLDTSSGDGIEAWVSLKEEDMVEFERH<br>EELVALAS | |
| | *P. somniferum* | MKVQVISKEIIKPSSPTPPHLRNFKLSLLDQILPPFYVPI<br>VMFYPAGDDYVTNNNIHDQSSKSEFLKKSLSETLTRF<br>YPIAGRIKDNILIDCNNEGVDYIEAKVNGIMSDFMSVD<br>VVHQLHPSHIMLDDVAKEAQLAVQVNLFDCGGIAISI<br>SMSHKIVDACTAITFINGWAATARAAPKQEIVCPTFDS<br>AAIFPALPPGVQVSSLESDDSVQGVNVVTKMFAFTAP<br>KIASLRARIAELRSSSDGLSKYPTRTEALSALVWKSFIR<br>TSRVKAARKYSLSPASTKPVIKSVANYAVNLRTRLNP<br>PLPQVSFGNILMDATAESTTTIDDDDSHEFADTLAGLI<br>GQLRLGVSRINGDYIRKLQEGDLAFLKSLDEASHDSN<br>GEKVQICWISSLCRFPFYEADFGWGKPSWVALNTNAE<br>YKNSLFLMDTKCGTGIEAWVSLEEDDMAIFEEDQDLL<br>QCVKSIN | SEQ. ID. NO. 41 |
| | *P. setigerum* | MENMKVEVVLKQTIKPSTQTPLHSKTFNLSFLDQHLG<br>PPIYIPFTLYYESGDVNNKNNHCDGYKNNLEEACEHR<br>VSVIKQSLSETLARYYPLAGRMKEDNLAVECNDEGV<br>EYFETRVSDVRLSQVIKRSPNHNSVLRKFLPPCIS SCD<br>NSMSIPFDYGFKSKTLLAIQVNIFECGGIVIGMCAHR<br>LADASTMFTFITDWAATARGAIEDIKGPSFDFSYTLFP<br>QKDVINNFKPFDPMLTREEDLVTKYFVFPASKIVELKR<br>RNVNNIVCQDTSQQNTSPCTRVEAVTSFMWKRYMDS<br>VRAKNQTQATSVEKYGALYTVNLRSRITPPLPANSFG<br>NIYTFTIALSTPSDENDIDDGLRKDVSSPNDLNLVGKV<br>RDAIKKIDDKYTRKLQSSEDELVNDVKPLTSGEAIFLG<br>FSSWCRFPIYEADFGWGKPTWVSIGTMALRNTVFLM<br>DTKSGDGIEAFVNMAKEDMDNFEVKLLADQ | SEQ. ID. NO. 42 |
| | *P. setigerum* | MENMKVEVVLEQTIKPSTQTPLHSKTFNLSFLDQHLG<br>PPIYIPFTLYYESGDVNNKNNHCDGYKNNLEEVCEHR<br>VSVIKQSLSETLARYYPLAGRMKEDNLAVECNDEGV<br>EYFETRVSDVRLSQVIKRSPNHNSVLRKFLPPCISSCD<br>NSMSIPFDYGFKSKTLLAIQVNIFECGGIVIGMCAHR<br>LADASTMFTFITDWAATARGAIEDIKGPSFDFSYTLFP<br>QKDVINNFKPFDPMLTREEDLVTKYFVFPASKIVELKR<br>RNVNNIVCQDTQQNTSPCTRVEAVTSFMWKRYMDS<br>VRAKNQTQATSVEKYGALYTVNLRSRITPPLPANSFG<br>NIYTFTIALSTPSDENDIDDGLRKDVSSPNDLNLVGKV<br>RDAIKKIDDKYTRKLQSSEDELVNDVKPLTSGEAIFLG<br>FSSWCRFPIYEADFGWGKPTWVSIGTMALRNTVFLM<br>DTKSGDGIEAFVNMAKEDMDNFEVKLLADQLLHVHP<br>TV | SEQ. ID. NO. 43 |
| | *P. setigerum* | MSSTVEVISKQTIKPSTPTPIQRKNHSLSLIDQHFAPIYI<br>PIVLFYPAAAVNDTGNVQHGDNTCVLKRSLSETLVHF<br>YPLAGRMKDNIVVDCNDQGVEFTEVKVSGTMCDFL<br>MKPDEQLSGLLPSEAVCMNFVREAQVMIQVNTFDCG<br>SKAISLCVSHKIADASTITTFSRCWAETTIAVSKSTSAV<br>TPIVSSKFHPTFDAASLFPPIKQLISPSGVTPALPELIPSE<br>ESKFGKIISKRFLFSATTINSVREKLSALMADKLKYRR<br>LTRVEVVSALIWNSFDKLATTGSVAVMVKHAVNLRK<br>RIDPPLPDVSFGNILEFTKAVVGEAAANTTTQGTVGSS<br>SKLLEELSEFAGQLREPVSKMNKGDHDFDMENTDYE<br>ERDLWMSSWCNYGLYDIDFGCGKPVWVTTVATMYP<br>YSDGFFMNDTRCGQGIEVWGNLVEEDMANFQLNLSE<br>LLDRI | SEQ. ID. NO. 44 |
| | *P. somniferum* | MMKVCVSSREKIKPSRPTPGHLKTHKLSFLDQVAARI<br>YVPLLLYYAGNKENVDTDTRCNIIKKSLAETLTKFYIL<br>AGKIVNDEIERFVNCNDDGVDFCVTKVSNCQLFQVIK<br>RPDIFDQVTLFLPFDPCDNEITASGDFLLSVQNVFED<br>CRGMVIGLCINHKVADASSITTFVNYWATIARGLVLN<br>VDDRQIQDPCFQVQSIFPQKEKGIGFKISSSSIDGTLVT<br>KKFGFEASKLAELKERCKFTTEPEDGYKPTRVEALSA<br>FLWKCFIDIDQAKLKGVARTKVYLATNAVNMRSRMV<br>PQLPTSSFGNIISITDAVFSINNDDSTGINDPYYPKLVRK<br>FRDAIKKIDRDYIEALRSTDLLLNNMMKLIEHVLSGHT | SEQ. ID. NO. 45 |

TABLE 2-continued

Example amino acid sequences of morphinan alkaloid generating enzymes.

| Sequence Name | Description | Sequence | SEQ. ID NO. |
|---|---|---|---|
| | | LSIYFSSWCRFPLYETDFGWGKPIWVSTCTIPQKNVIV LMDSNSSADGIEAYVTLAKEDMGELEHHEELLALIS | |
| Dirigent proteins | | | |
| | P. somniferum | MGAMKFFSFLAVAMVLSLAHIQAQQGNWGDETVPY TMGPEKITKLRFYFHDIVTGNNPTAVQIAQATGTNSSS TLFGALFMIDDPLTEGPDPDSRLVGRAQGFYGSAGQN EAALILGMSLVFTGNEKFNGSTISVLSRNPVTHTEREF AIVGGTYFQFARGFISAKTYSLVGPNAVVEYNCTIV HPSSVSESGKSNSSPGKSDSNSGSQISLGSNLVFVSVIA YVTIILSL | SEQ. ID. NO. 46 |
| | P. setigerum | MVLSMSHSQAQEGNWGDESVPYTMGPEKMTKLRFY FHDIITGNSPTAVQIAQATGTNTSATMFGALMMIDDPL TEGPDPNSRLVGRAQGFYGSAGQNELALILGMSLVFT GNEKFNGSTISVLSRNPVMHTEREFAIVGGTYFQFA RGFISAKTYSLVGPNAVVEYNCTIVHPSSVSESGKSDS SSGKSDSSSGSQISLGTNLVFLSVIAFVTIIVSPQHFSW | SEQ. ID. NO. 47 |
| Chalcone isomerase | | | |
| | P. somniferum | MTKTVLVDDIPFPQNITTVTTEKQLPLLGQGITDMEIH FLQIKFTAIGTAIGVYLEPEIASHLQQWKGKTGAELSQ DDEFFAAVVSASVEKYVRVVVIKEIKGSQYMLQLES WVRDELAAADKYEDEEEESLDKVIEFFQSKYLKQLSF IPSHFSATTPAVAEIGLEIEGQKDLKIKVENGNVIEMIQ KWYLGGTRGVSPSTTQSLATSL | SEQ. ID. NO. 48 |
| | P. somniferum | MPFLKAIEIEGCKFRPFVTPPGSTQILFLAGSGVKEEFG DSKSMKYSSCAIYLQPTCILYLAKAWAQKSVVDITQS LNFFMDIATGPFEKYCRITMLETAKGEDYAAMITKNC EEMLTNSKRYSETAKAALTKFSEAFNGRTLASGSSIH VTVSTSNSVTLAFTEDGSTPKQGDVTLDCKEVGEAFL MSTISLHTTIRESMGSRISGLYK | SEQ. ID. NO. 49 |
| | P. setigerum | MAPMAQLSEIQVEQFVFPPTMTPPSSTESLFLGGAGVR GLQIQDRFIKFTAIGVYLAEEAIPSLSPKWKSKSPEELT DDVEFFMDIVTGPFEKFVKITMILPLTGDQYAEKVTEN CIQYLKSKDMYTDAEAKAVERFIEIFKNEMFPPASSIL FTISPAGSLTVGF* | SEQ. ID. NO. 50 |
| | P. rhoeas | MVYLEPEIATHLKQWKGKTGAELSQDDDFFSAVVSA PVEKYVRVVVIKEIKGSQYMLQLESWVRDELAAADK YEDEEEESLDKVIEFFQSKYLKQHSVIITFHFSATTPAV AEIGLEIEGQKDLKIKVENGNVVEMIQKWYLGGTRGV SPSTTQSLATSL | SEQ. ID. NO. 51 |
| | P. bracteatum | MTKMVLVDDIPFPQNITTATTAKQLPLLGQGITDMEIH FLQIKFTAIGVYLEPEIASHLKQWKGKTGAELSQDDEF FSAIVSAPVEKYVRVVVIKEIKGSQYMLQLESWVRDE LAAADKYEDEEEESLEKVIEFFQSKYLKQHSVIPFHFS ATTPAVAEIGLEIEGHKDLKMKVENGNVVEMIQKWY LAGTRGVSPSTTQSLATSL | SEQ. ID. NO. 52 |
| | P. bracteatum | MAPMAQLSEIQVEQFVFPPTMTPPSSTESLFLGGAGVR GLQIQDRFIKFTAIGVYLAEEAIPSLSPKWKSKTPEELT NDVEFFMDIVTGPFEKFVKITMILPLTGDQYAEKVTEN CVEYLKSKDLYTDAEAKAVERFIEIFKNEMFPPASSIL FTISPTGSLTVGFSKDTSIPEARNAVIENKALSESILESII GKNGVSPAAKQSLAERISELLK | SEQ. ID. NO. 53 |
| Other | | | |
| | P. ginseng | MGLTGKLICQTGIKSDGDVFHELFGTRPHHVPNITPAN IQGCDLHEGEFGKVGSVVIWNYSIDGNAMIAKEEIVAI DEEDKSVTFKVVEGHLFEEFKSIVFSVHVDTKGEDNL VTWSIDYEKLNESVKDPTSYLDFLLSVTRDIEAHHLPK | SEQ. ID. NO. 54 |

TABLE 2-continued

Example amino acid sequences of morphinan alkaloid generating enzymes.

| Sequence Name | Description | Sequence | SEQ. ID NO. |
|---|---|---|---|
| | A. hypogaea | MGVFTFEDEITSTVPPAKLYNAMKDADSITPKIIDDVK SVEIVEGNGGPGTIKKLTIVEDGETKFILHKVESIDEAN YAYNYSVVGGVALPPTAEKITFETKLVEGPNGGSIGK LTLKYHTKGDAKPDEEELKKGKAKGEGLFRAIEGYV LANPTQY | SEQ. ID. NO. 55 |
| | H. perforatum | MGIDPFTMAAYTIVKEEESPIAPHRLFKALVLERHQVL VKAQPHVFKSGEIIEGDGGVGTVTKITFVDGHPLTYM LHKFDEIDAANFYCKYTLFEGDVLRDNIEKVVYEVKL EAVGGGSKGKITVTYHPKPGCTVNEEEVKIGEKKAYE FYKQVEEYLAANPEVFA | SEQ. ID. NO. 56 |
| | L. luteus | MGVFTFQDEYTSTIAPAKLYKALVTDADIIIPKAVETI QSVEIVEGNGGPGTIKKLTFIEGGESKYVLHKIEAIDEA NLGYNYSIVGGVGLPDTIEKISFETKLVEGANGGSIGK VTIKIETKGDAQPNEEEGKAAKARGDAFFKAIESYLSA HPDYN | SEQ. ID. NO. 57 |
| | Strawberry (Fragaria x ananassa) | MAGVFTYETEFTSVIPPPRLFKAFILDADNLIPKIAPQA VKCAEIIEGDGGVGTIKKITFGEGSQFGSVTHKIDGIDK ENFVYSYSLIEGDALSDKIEKISYETKLVSSSDGGSIIKS TSNYHTKGDVEIKEEHVKAGKEKFSHLFKLVEGYLLA NPNEYC | SEQ. ID. NO. 58 |
| | A. deliciosa | MDLSGKMVKQVEILSDGIVFYEIFRYRLYLISEMSPVN IQGVDLLEGNWGTVGSVIFFKYTIDGKEKTAKDIVEAI DEETKSVTFKIVEGDLMELYKTFIIIVQVDTKGEHNSV TWTFHYEKLKEDVEEPNTLMNFCIEITKDIETYHLK | SEQ. ID. NO. 59 |
| | T. flavum | MGIINQVSTVTKVIHHELEVAASADDIWTVYSWPGLA KHLPDLLPGAFEKLEIIGDGGVGTILDMTFVPGEFPHE YKEKFILVDNEHRLKKVQMIEGGYLDLGVTYYMDTI HVVPTGKDSCVIKSSTEYHVKPEFVKIVEPLITTGPLA AMADAISKLVLEHKS | SEQ. ID. NO. 60 |
| | V. radiata | MVKEFNTQTELSVRLEALWAVLSKDFITVVPKVLPHI VKDVQLIEGDGGVGTILIFNFLPEVSPSYQREEITEFDE SSHEIGLQVIEGGYLSQGLSYYKTTFKLSEIEEDKTLV NVKISYDHDSDIEEKVTPTKTSQSTLMYLRRLERYLSN GSA | SEQ. ID. NO. 61 |

BisBIA Generating Modifications

Some methods, processes, and systems provided herein describe the increased production of bisbenzylisoquinoline alkaloids (bisBIAs) by utilizing two separate epimerase enzymes derived from a parent epimerase enzyme when compared to production of the bisBIAs by utilizing a corresponding fused enzyme. In examples, a corresponding fused enzyme comprises a fused epimerase having corresponding oxidase and reductase regions to the two separate epimerase enzymes. In examples, the two separate epimerase enzymes may comprise an oxidase and a reductase. BisBIAs are dimeric molecules that may be formed by coupling reactions between two BIA monomers. In examples, bisBIAs may be formed by carbon-oxygen coupling reactions. In other examples, bisBIAs may be formed by carbon-carbon coupling reactions. In some examples, the bisBIA dimeric molecule is a homodimer, comprising two identical BIA monomers. In examples, an engineered host cell may produce one BIA monomer. In these examples, the BIA monomers may form homodimers when contacted with one or more coupling enzymes. In other examples, the bisBIA dimeric molecule is a heterodimer, comprising two different BIA monomers. For example, a bisBIA may be a heterodimer that comprises BIA monomers that are enantiomers of each other. In some examples, an engineered host cell may produce two or more BIA monomers. In these examples, the BIA monomers may form homodimers and heterodimers when contacted with one or more coupling enzymes.

Some of these methods, processes, and systems that describe the production of bisBIAs may comprise an engineered host cell. In some examples, the engineered host cell may be engineered to produce BIA monomers which, in turn, may be used as building block molecules for forming bisBIAs. Examples of BIA monomers that may be used to form bisBIAs include coclaurine, N-methylcoclaurine, laudanine, norcoclaurine, norlaudanosoline, 6-O-methyl-norlaudanosoline, 3'-hydroxy-N-methylcoclaurine, 3'-hydroxycoclaurine, reticuline, norreticuline, norlaudanine, laudanosine, and papaverine. In particular, engineered host cells may synthesize BIA monomers from norcoclaurine or norlaudanosoline by expression of heterologous enzymes including O-methyltransferases, N-methyltransferases, and 3'-hydroxylases. Examples of O-methyltransferases may include norcoclaurine 6-O-methyltransferase (6OMT). Further examples of O-methyltransferases may include catechol O-methyltransferase (COMT). Further examples of N-methyltransferases may include coclaurine N-methyltransferase (CNMT). Examples of 3'hydroxylases may include N-methylcoclaurine 3'-hydroxylase (CYP80B1).

The engineered host cells may produce either (S) or (R) enantiomers of any given BIA monomer. Additionally or alternatively, the engineered host cells may produce a mixture of both enantiomers. The ratio of (S) and (R) enantiomers may be determined by the substrate and product specificities of the one or more enzymes that synthesize the BIA monomers. Alternatively, the amount of each enantiomer present may be modified by the expression and engagement of the two separate oxidase and reductase enzymes of the engineered epimerase that performs the epimerization of one stereoisomer into another. In some cases, the amount of each enantiomer present may be modified by the expression and engagement of the engineered fused epimerase that performs the epimerization of one stereoisomer into another.

These BIA monomers may be fused into a dimeric bisBIA scaffold. In particular, the BIA monomers may be fused into a dimeric bisBIA scaffold utilizing one or more enzymes that are produced by the engineered host cell. Additionally or alternatively, the BIA monomers may be fused into a dimeric bisBIA scaffold utilizing one or more enzymes that are provided to the BIA monomers from a source that is external to the engineered host cell. The one or more enzymes may be used to form carbon-oxygen and/or carbon-carbon coupling reactions to fuse two BIA monomers at one, two, or three positions. In some examples, two BIA monomers may be linked by an ether bridge. In some examples, a direct carbon-carbon bond may be used to connect the two BIA monomers. In some examples, a bisBIA that is formed by fusing two BIA monomers may comprise one diphenyl ether linkage. In some examples, two BIA monomers may be fused to form a bisBIA that comprises two diphenyl ether linkages. In some examples, a bisBIA that is formed from two BIA monomers may comprise three diphenyl ether linkages. In some examples, the bisBIA may comprise one diphenyl ether linkage and one benzyl phenyl ether linkage. In some cases, the bisBIA may comprise one benzyl phenyl ether linkage and two diphenyl ether linkages.

In examples, the BIA monomers may be contacted with a sufficient amount of the one or more enzymes that may be used to form coupling reactions to fuse two BIA monomers such that at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, at least 99.5%, at least 99.7%, or 100% of said BIA monomers are converted to bisBIAs. The one or more enzymes that may be used to dimerize the BIA monomers into bisBIAs may contact the BIA monomers in vitro. Additionally, or alternatively, the one or more enzymes that may be used to dimerize the BIA monomers into bisBIAs may contact the BIA monomers in vivo. Additionally, the one or more bisBIA dimerizing enzyme may be expressed in a host cell that produces BIA monomers. Alternatively, the BIA monomers may be provided to the engineered host cell that expresses the bisBIA dimerizing enzyme. Alternatively, the one or more bisBIA dimerizing enzymes may be provided to a cell having BIA monomers within.

In some examples, the bisbenzylisoquinoline alkaloid is a compound of any one of Formulas Va-Vu:

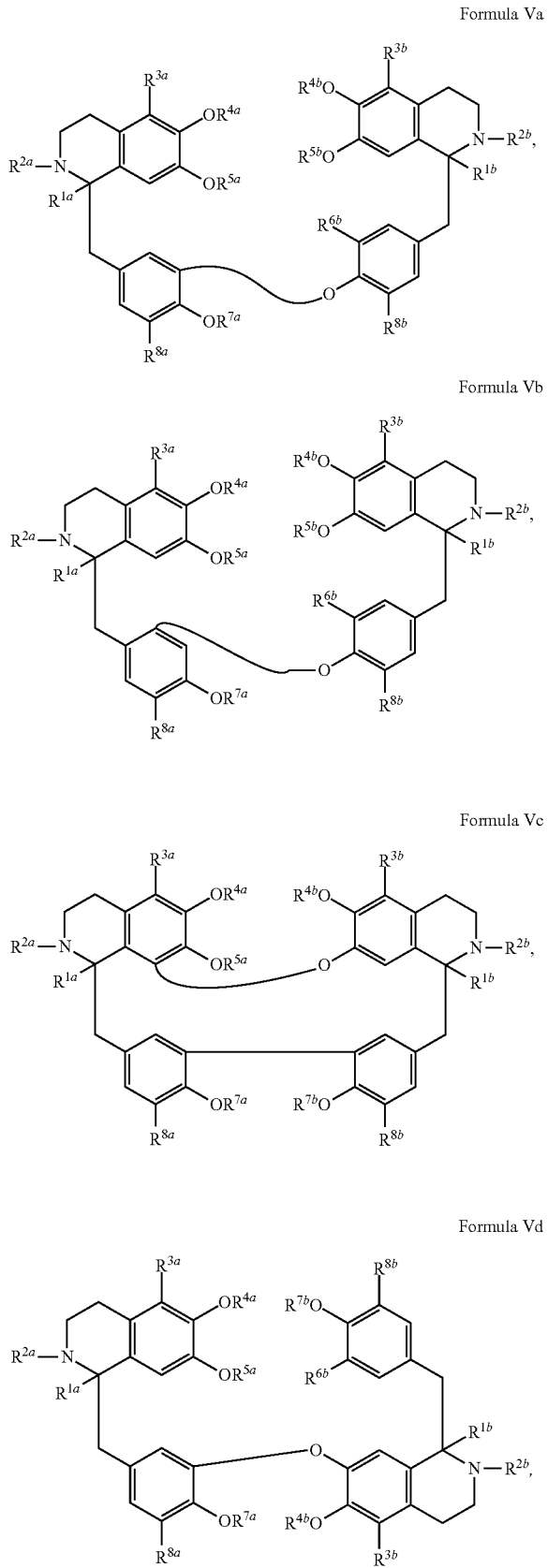

Formula Ve
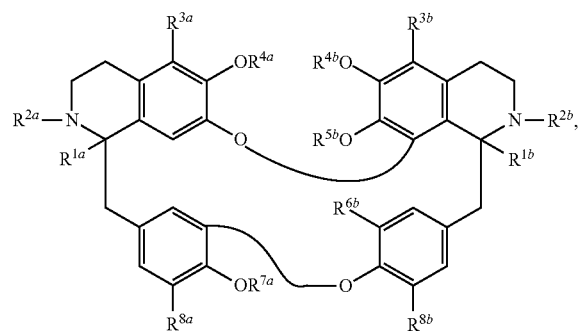
Formula Vf
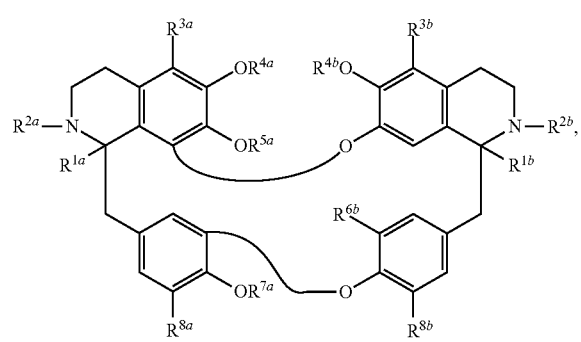
Formula Vg
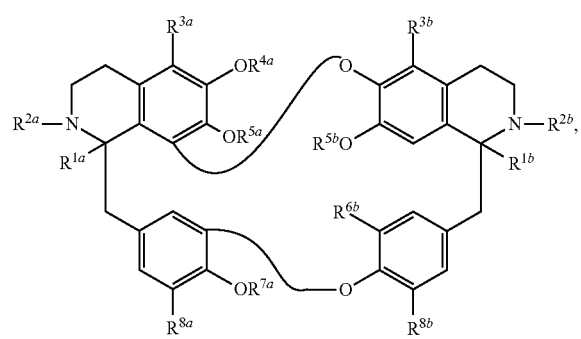
Formula Vh
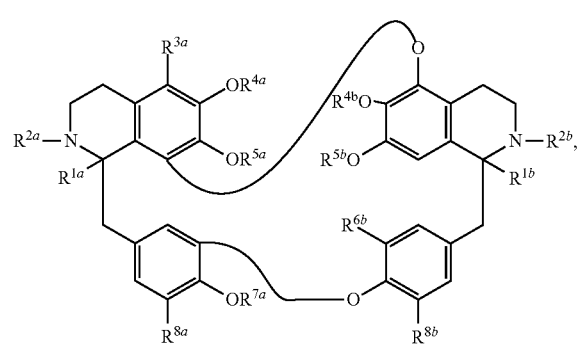
Formula Vi
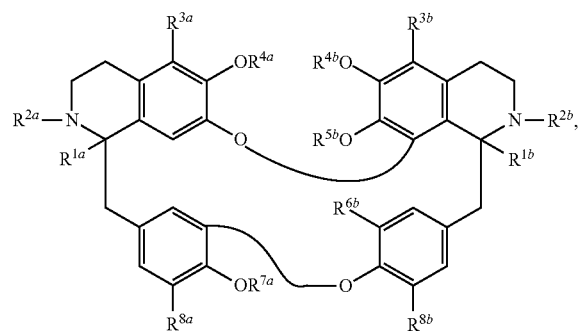
Formula Vj
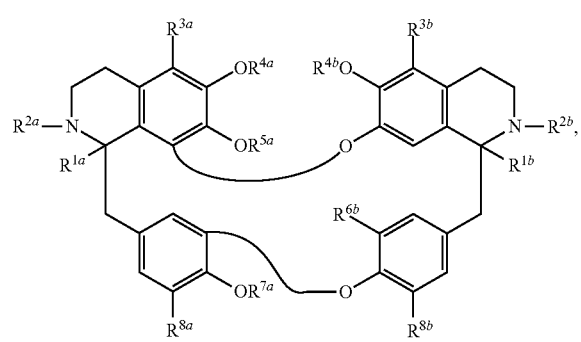
Formula Vk
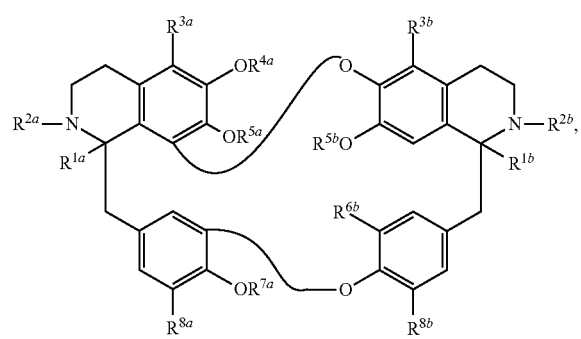
Formula Vl
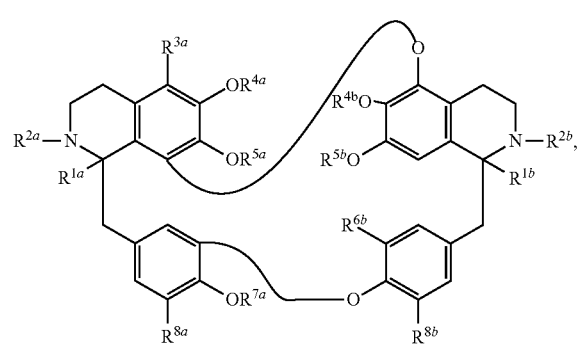

Formula Vm
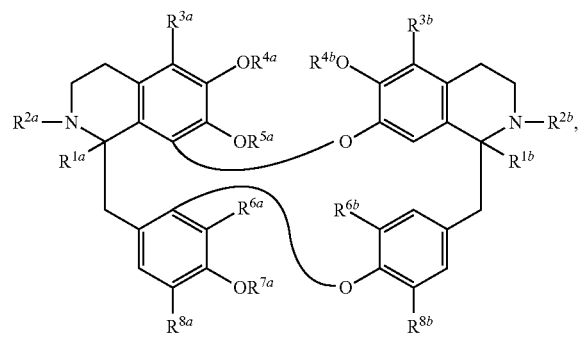
Formula Vn
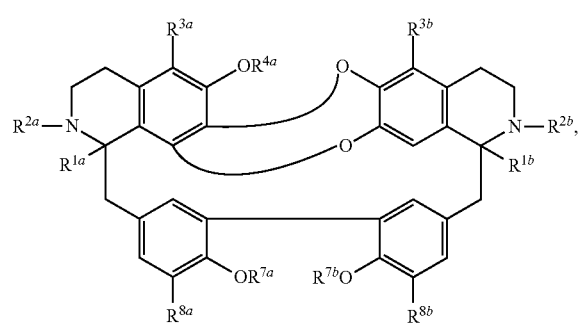
Formula Vo
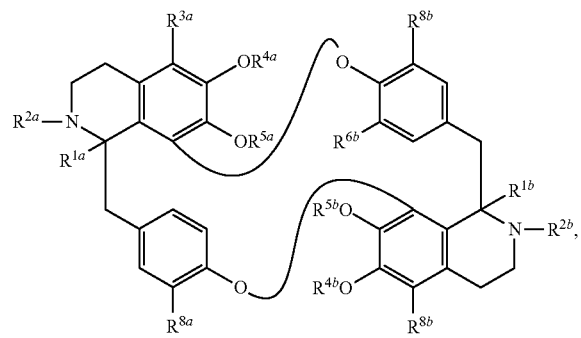
Formula Vp
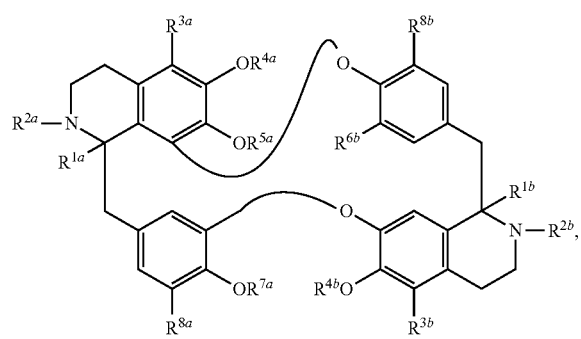
Formula Vq
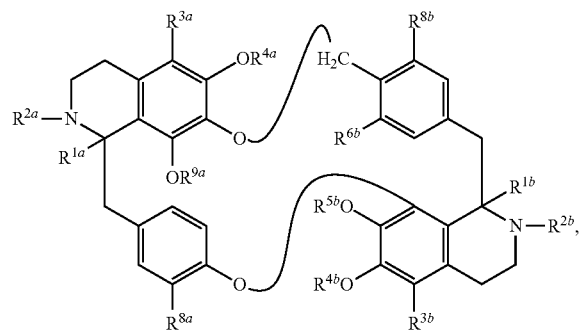
Formula Vr
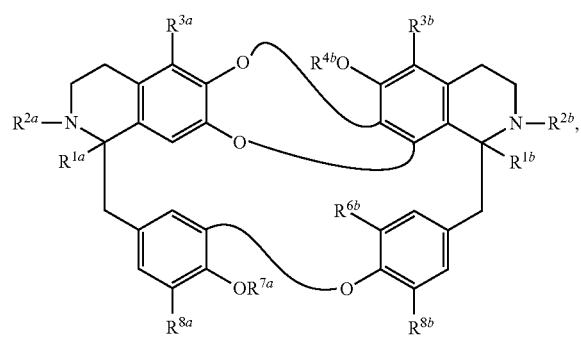
Formula Vs
Formula Vt
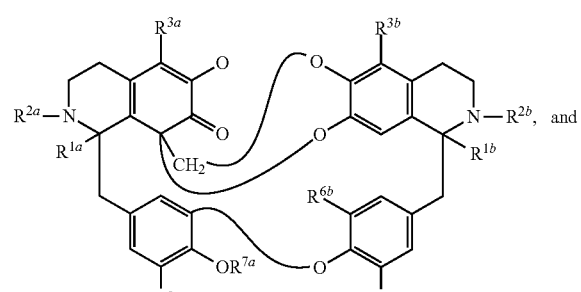

Formula Vu

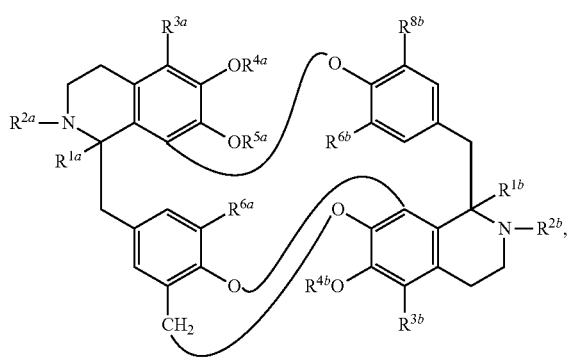

or a salt thereof, wherein:
$R^{1a}$, $R^{1b}$, $R^{2a}$, and $R^{2b}$ are independently selected from hydrogen and $C_1$-$C_4$ alkyl;
$R^{3a}$, $R^{3b}$, $R^{6a}$, $R^{6b}$, $R^{8a}$, and $R^{8b}$ are independently selected from hydrogen, hydroxy, fluoro, chloro, bromo, carboxaldehyde, $C_1$-$C_4$ acyl, $C_1$-$C_4$ alkyl, and $C_1$-$C_4$ alkoxy;
$R^{4a}$ and $R^{5a}$ are independently selected from hydrogen and $C_1$-$C_4$ alkyl, or $R^{4a}$ and $R^{5a}$ together form a methylene bridge;
$R^{4b}$ and $R^{5b}$ are independently selected from hydrogen and $C_1$-$C_4$ alkyl, or $R^{4b}$ and $R^{5b}$ together form a methylene bridge; and
$R^{7a}$, $R^{7b}$, and $R^{9a}$ are independently selected from hydrogen and $C_1$-$C_4$ alkyl.

In some examples, $R^{1a}$ and $R^{1b}$ are each hydrogen; $R^{2a}$ and $R^{2b}$ are each methyl; $R^{3a}$ and $R^{3b}$ are each hydrogen; $R^{4a}$ and $R^{5a}$ are independently hydrogen or methyl; $R^{4b}$ and $R^{5b}$ are independently hydrogen or methyl, or $R^{4b}$ and $R^{5b}$ together form a methylene bridge; $R^{6a}$, $R^{6b}$, $R^{8a}$, and $R^{8b}$ are each hydrogen; and $R^{7a}$, $R^{7b}$, and $R^{9a}$ are independently hydrogen or methyl.

As illustrated above, the bisBIA compounds of Formulas Va, Vb, and Vd are formed by fusing two BIA monomers using a carbon-oxygen coupling reaction. Additionally, the bisBIA compounds of Formulas Vc, Vf, and Vh are formed by fusing two BIA monomers using both a carbon-oxygen coupling reaction and a carbon-carbon coupling reaction. Further, the bisBIA compounds of Formulas Ve, Vg, Vi, Vj, Vk, Vl, Vm, Vo, Vp, and Vq are formed by fusing two BIA monomers using two carbon-oxygen coupling reactions. The bisBIA compound of Formula Vn is formed by fusing two BIA monomers using two carbon-oxygen coupling reactions and a carbon-carbon coupling reaction. Additionally, the bisBIA compound of Formula Vr is formed by fusing two BIA monomers using three carbon-oxygen coupling reactions.

The one or more enzymes that may be used to form the coupling reactions may include known cytochrome P450s such as *Berberis stolonifera* CYP80A1 or similar cytochrome P450 enzymes from other plants that naturally synthesize these compounds. Alternatively, the coupling reaction may be performed by an enzyme that is not a cytochrome P450. The one or more enzymes that may be used to form the coupling reactions may be engineered to accept non-native substrates. Accordingly, the one or more enzymes that may be used to form the coupling reactions may be used to generate non-natural bisBIA molecules. In examples, the one or more enzymes may fuse a natural BIA monomer with a non-natural BIA monomer to produce a non-natural bisBIA molecule. In other examples, the one or more enzymes may fuse two non-natural BIA monomers to produce a non-natural bisBIA molecule. Enzyme engineered strategies may be used to identify one or more enzymes that may be used to form the coupling reactions that fuse BIA monomers to produce bisBIAs. In examples, enzyme engineering strategies may include site directed mutagenesis, random mutagenesis and screening, DNA shuffling, and screening.

Once bisBIAs are formed, the bisBIAs may be further derivatized or modified. The bisBIAs may be derivatized or modified utilizing one or more enzymes that are produced by the engineered host cell. In particular, the bisBIAs may be derivatized or modified by contacting the bisBIAs with one or more enzymes that are produced by the engineered host cell. Additionally or alternatively, the bisBIAs may be derivatized or modified by contacting the bisBIAs with one or more enzymes that are provided to the bisBIAs from a source that is external to the engineered host cell. The one or more enzymes that may be used to derivatize or modify the bisBIAs may be used to perform tailoring reactions. Examples of tailoring reactions include oxidation, reduction, O-methylation, N-methylation, O-demethylation, acetylation, methylenedioxybridge formation, and O, O-demethylenation. A bisBIA may be derivatized or modified using one or more tailoring reactions.

Examples of tailoring reactions are provided in Table 9. In some examples, tailoring enzymes may be used to catalyze carbon-carbon coupling reactions performed on a bisBIA, or a derivative thereof. Examples of tailoring enzymes that may be used to catalyze carbon-carbon coupling reactions include a Berberine bridge enzyme (BBE) from *Papaver somniferum*, *Eschscholzia californica*, *Coptis japonica*, *Berberis stolonifer*, *Thalictrum flavum*, or another species; Salutaridine synthase (SalSyn) from *Papaver somniferum* or another species; and Corytuberine synthase (CorSyn) from *Coptis japonica* or another species. Non-limiting examples of reactions that can be catalyzed by tailoring enzymes are shown in Scheme 3, wherein $R^a$, $R^b$, $R^c$, and $R_d$ are independently selected from hydrogen, hydroxy, fluoro, chloro, bromo, carboxaldehyde, $C_1$-$C_4$ acyl, $C_1$-$C_4$ alkyl, and $C_1$-$C_4$ alkoxy. In some examples, $R^a$, $R^b$, and the carbon atoms to which they are attached optionally form a carbocycle or heterocycle. In some examples, $R^c$, $R^d$, and the carbon atoms to which they are attached optionally form a carbocycle or heterocycle.

Scheme 3

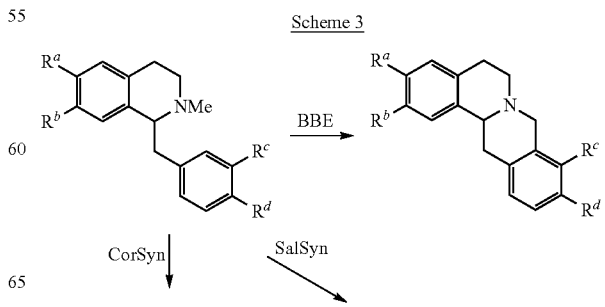

-continued

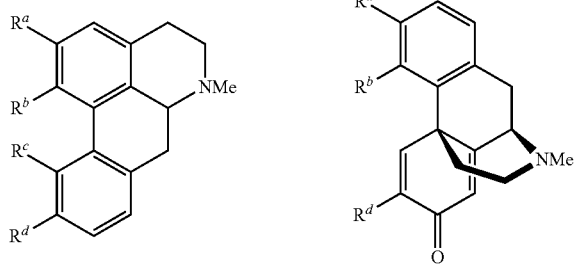

In some examples, tailoring enzymes may be used to catalyze oxidation reactions performed on a bisBIA, or a derivative thereof. Examples of tailoring enzymes that may be used to catalyze oxidation reactions include a Tetrahydroprotoberberine oxidase (STOX) from *Coptis japonica, Argemone mexicana, Berberis wilsonae*, or another species; Dihydrobenzophenanthridine oxidase (DBOX) from *Papaver somniferum* or another species; Methylstylopine hydroxylase (MSH) from *Papaver somniferum* or another species; and Protopine 6-hydroxylase (P6H) from *Papaver somniferum, Eschscholzia californica*, or another species.

Tailoring enzymes may also be used to catalyze methylenedioxy bridge formation reactions performed on a bisBIA, or a derivative thereof. Examples of tailoring enzymes that may be used to catalyze methylenedioxy bridge formation reactions include a Stylopine synthase (StySyn) from *Papaver somniferum, Eschscholzia californica, Argemone mexicana*, or another species; Cheilanthifoline synthase (CheSyn) from *Papaver somniferum, Eschscholzia californica, Argemone mexicana*, or another species; and Canadine synthase (CAS) from *Thalictrum flavum, Coptis chinensis*, or another species.

In other examples, tailoring enzymes may be used to catalyze O-methylation reactions performed on a bisBIA, or a derivative thereof. Examples of tailoring enzymes that may be used to catalyze O-methylation reactions include a Norcoclaurine 6-O-methyltransferase (6OMT) from *Papaver somniferum, Thalictrum flavum, Coptis japonica, Papaver bracteatum*, or another species; 3'hydroxy-N-methylcoclaurine 4'-O-methyltransferase (4'OMT) from *Papaver somniferum, Thalictrum flavum, Coptis japonica, Coptis chinensis*, or another species; Reticuline 7-O-methyltransferase (7OMT) from *Papaver somniferum, Eschscholzia californica*, or another species; and Scoulerine 9-O-methyltransferase (9OMT) from *Papaver somniferum, Thalictrum flavum, Coptis japonica, Coptis chinensis*, or another species.

Additionally, tailoring enzymes may be used to catalyze N-methylation reactions performed on a bisBIA, or a derivative thereof. Examples of tailoring enzymes that may be used to catalyze N-methylation reactions include Coclaurine N-methyltransferase (CNMT) from *Papaver somniferum, Thalictrum flavum, Coptis japonica*, or another species; Tetrahydroprotoberberine N-methyltransferase (TNMT) from *Papaver somniferum, Eschscholzia californica, Papaver bracteatum*, or another species.

Further, tailoring enzymes may be used to catalyze O-demethylation reactions performed on a bisBIA, or a derivative thereof. Examples of tailoring enzymes that may be used to catalyze O-demethylation reactions include Thebaine demethylase (T6ODM) from *Papaver somniferum* or another species; and Codeine demethylase (CODM) from *Papaver somniferum*, or another species.

Tailoring enzymes may also be used to catalyze reduction reactions performed on a bisBIA, or a derivative thereof. Examples of tailoring enzymes that may be used to catalyze reduction reactions include Salutaridine reductase (SalR) from *Papaver somniferum, Papaver bracteatum*, or another species; Codeinone reductase (COR) from *Papaver somniferum* or another species; and Sanguinarine reductase (SanR) from *Eschscholzia californica* or another species. In other examples, tailoring enzymes may be used to catalyze acetylation reactions performed on a bisBIA, or a derivative thereof. An example of a tailoring enzyme that may be used to catalyze acetylation reactions includes Salutaridine acetyltransferase (SalAT) from *Papaver somniferum* or another species.

O-Demethylation Modifications

Some methods, processes, and systems provided herein describe the conversion of a first benzylisoquinoline alkaloid to a second benzylisoquinoline alkaloid by the removal of an O-linked methyl group. Some of these methods, processes, and systems may comprise an engineered host cell. In some examples, the conversion of a first benzylisoquinoline alkaloid to a second benzylisoquinoline alkaloid is a key step in the conversion of a substrate to a nor-opioids or nal-opioids. In some examples, the conversion of a first alkaloid to a second alkaloid comprises a demethylase reaction.

FIG. 6 illustrates an enzyme having opioid 3-O-demethylase (ODM) activity, in accordance with embodiments of the invention. Specifically, the enzyme may act on any morphinan alkaloid structure to remove the methyl group from the oxygen bound to carbon 3.

Examples of amino acid sequences of ODM enzymes are set forth in Table 4. An amino acid sequence for an ODM that is utilized in converting a first alkaloid to a second alkaloid may be 75% or more identical to a given amino acid sequence as listed in Table 4. For example, an amino acid sequence for such an epimerase may comprise an amino acid sequence that is at least 75% or more, 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more, or 99% or more identical to an amino acid sequence as provided herein. Additionally, in certain embodiments, an "identical" amino acid sequence contains at least 80%-99% identity at the amino acid level to the specific amino acid sequence. In some cases an "identical" amino acid sequence contains at least about 85%, 86%, 87%, 88%, 89%, 90%, 91%, 92%, 93%, 94% and more in certain cases, at least 95%, 96%, 97%, 98% and 99% identity, at the amino acid level. In some cases, the amino acid sequence may be identical but the DNA sequence is altered such as to optimize codon usage for the host organism, for example.

An engineered host cell may be provided that produces an ODM that converts a first alkaloid to a second alkaloid, wherein the ODM comprises a given amino acid sequence as listed in Table 4. An engineered host cell may be provided that produces one or more ODM enzymes. The ODM that is produced within the engineered host cell may be recovered and purified so as to form a biocatalyst. The process may include contacting the first alkaloid with an ODM in an amount sufficient to convert said first alkaloid to a second alkaloid. In examples, the first alkaloid may be contacted with a sufficient amount of the one or more enzymes such that at least 5% of said first alkaloid is converted to a second alkaloid. In further examples, the first alkaloid may be contacted with a sufficient amount of the one or more enzymes such that at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, at least 99.5%, at least 99.7%, or 100% of said first alkaloid is converted to a second alkaloid.

The one or more enzymes that may be used to convert a first alkaloid to a second alkaloid may contact the first alkaloid in vitro. Additionally, or alternatively, the one or more enzymes that may be used to convert a first alkaloid to a second alkaloid may contact the first alkaloid in vivo. In some examples, the one or more enzymes that may be used to convert a first alkaloid to a second alkaloid may be provided to a cell having the first alkaloid within. In some examples, the one or more enzymes that may be used to convert a first alkaloid to a second alkaloid may be produced within an engineered host cell.

In some examples, the methods provide for engineered host cells that produce an alkaloid product, wherein the O-demethylation of a substrate to a product may comprise a key step in the production of an alkaloid product. In some examples, the alkaloid produced is a nor-opioid or a nal-opioid. In still other embodiments, the alkaloid produced is derived from a nor-opioid or a nal-opioid. In another embodiment, a first alkaloid is an intermediate toward the product of the engineered host cell. In still other embodiments, the alkaloid product is selected from the group consisting of morphine, oxymorphine, oripavine, hydromorphone, dihydromorphine, 14-hydroxymorphine, morphinone, and 14-hydroxymorphinone.

In some examples, the substrate alkaloid is an opioid selected from the group consisting of codeine, oxycodone, thebaine, hydrocodone, dihydrocodeine, 14-hydroxycodeine, codeinone, and 14-hydroxycodeinone.

N-Demethylation Modifications

Some methods, processes, and systems provided herein describe the conversion of a first alkaloid to a second alkaloid by the removal of an N-linked methyl group. Some of these methods, processes, and systems may comprise an engineered host cell. In some examples, the conversion of a first alkaloid to a second alkaloid is a key step in the conversion of a substrate to a nor-opioids or nal-opioids. In some examples, the conversion of a first alkaloid to a second alkaloid comprises a demethylase reaction.

Figure 7:
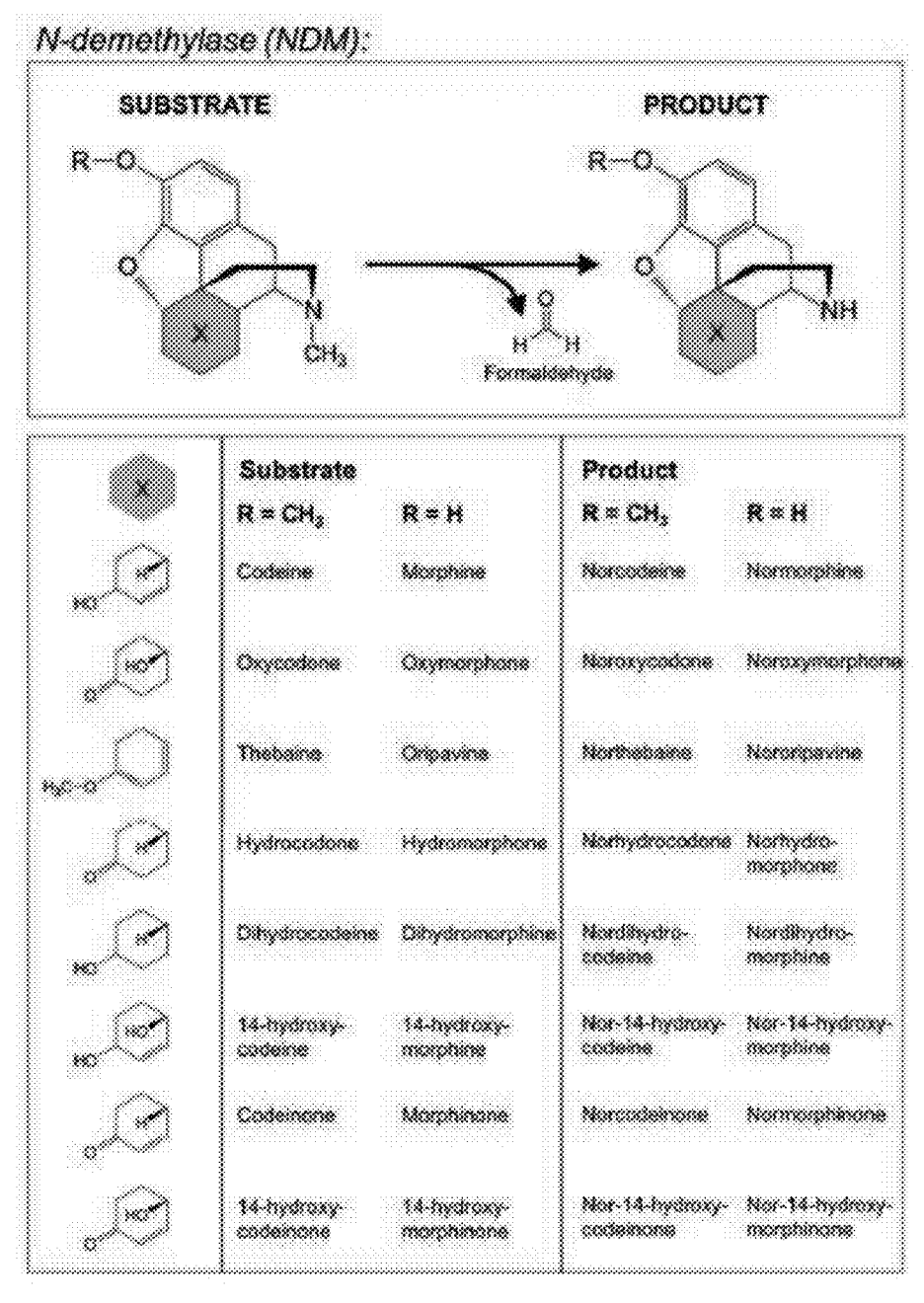

FIG. 7 illustrates an enzyme having opioid N-demethylase activity, in accordance with embodiments of the invention. Specifically, the enzyme may act on any morphinan alkaloid structure to remove the methyl group from the nitrogen.

Examples of an amino acid sequence of an N-demethylase (NDM) enzyme that may be used to perform the conversion a first alkaloid to a second alkaloid are provided in Table 5. An amino acid sequence for an NDM that is utilized in converting a first alkaloid to a second alkaloid may be 75% or more identical to a given amino acid sequence as listed in Table 5. For example, an amino acid sequence for such an epimerase may comprise an amino acid sequence that is at least 75% or more, 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more, or 99% or more identical to an amino acid sequence as provided herein. Additionally, in certain embodiments, an "identical" amino acid sequence contains at least 80%-99% identity at the amino acid level to the specific amino acid sequence. In some cases an "identical" amino acid sequence contains at least about 85%, 86%, 87%, 88%, 89%, 90%, 91%, 92%, 93%, 94% and more in certain cases, at least 95%, 96%, 97%, 98% and 99% identity, at the amino acid level. In some cases, the amino acid sequence may be identical but the DNA sequence is altered such as to optimize codon usage for the host organism, for example.

An engineered host cell may be provided that produces an NDM that converts a first alkaloid to a second alkaloid, wherein the NDM comprises an amino acid sequence as listed in Table 5. An engineered host cell may be provided that produces one or more NDM enzymes. The NDM that is produced within the engineered host cell may be recovered and purified so as to form a biocatalyst. The process may include contacting the first alkaloid with an NDM in an amount sufficient to convert said first alkaloid to a second alkaloid. In examples, the first alkaloid may be contacted with a sufficient amount of the one or more enzymes such that at least 5% of said first alkaloid is converted to a second alkaloid. In further examples, the first alkaloid may be contacted with a sufficient amount of the one or more enzymes such that at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, at least 99.5%, at least 99.7%, or 100% of said first alkaloid is converted to a second alkaloid.

The one or more enzymes that may be used to convert a first alkaloid to a second alkaloid may contact the first alkaloid in vitro. Additionally, or alternatively, the one or more enzymes that may be used to convert a first alkaloid to a second alkaloid may contact the first alkaloid in vivo. In some examples, the one or more enzymes that may be used to convert a first alkaloid to a second alkaloid may be provided to a cell having the first alkaloid within. In some examples, the one or more enzymes that may be used to convert a first alkaloid to a second alkaloid may be produced within an engineered host cell.

In some examples, the methods provide for engineered host cells that produce an alkaloid product, wherein the N-demethylation of a substrate to a product may comprise a key step in the production of an alkaloid product. In some examples, the alkaloid produced is a nor-opioid or a nal-opioid. In still other embodiments, the alkaloid produced is derived from a nor-opioid or a nal-opioid. In another embodiment, a first alkaloid is an intermediate toward the product of the engineered host cell. In still other embodiments, the alkaloid product is selected from the group consisting of norcodeine, noroxycodone, northebaine, norhydrocodone, nordihydro-codeine, nor-14-hydroxy-codeine, norcodeinone, nor-14-hydroxy-codeinone, normorphine, noroxymorphone, nororipavine, norhydro-morphine, nordihydro-morphine, nor-14-hydroxy-morphine, normorphinone, and nor-14-hydroxy-morphinone.

In some examples, the substrate alkaloid is an opioid selected from the group consisting of codeine, oxycodone, thebaine, hydrocodone, dihydrocodeine, 14-hydroxycodeine, codeinone, 14-hydroxycodeinone, morphine, oxymorphone, oripavine, hydromorphone, dihydromorphine, 14-hydroxy-morphine, morphinone, and 14-hydroxy-morphinone.

N-Methyltransferase Modifications

Some methods, processes, and systems provided herein describe the conversion of a first alkaloid to a second alkaloid by the addition of an N-linked sidechain group. Some methods, processes, and systems provided herein describe the conversion of a first alkaloid to a second alkaloid by the transfer of a sidechain group from a cosubstrate to the first alkaloid. Some of these methods, processes, and systems may comprise an engineered host cell. In some examples, the conversion of a first alkaloid to a second alkaloid is a key step in the conversion of a substrate to a nal-opioid. In some examples, the conversion of a first alkaloid to a second alkaloid comprises a methyltransferase reaction.

Figure 8:
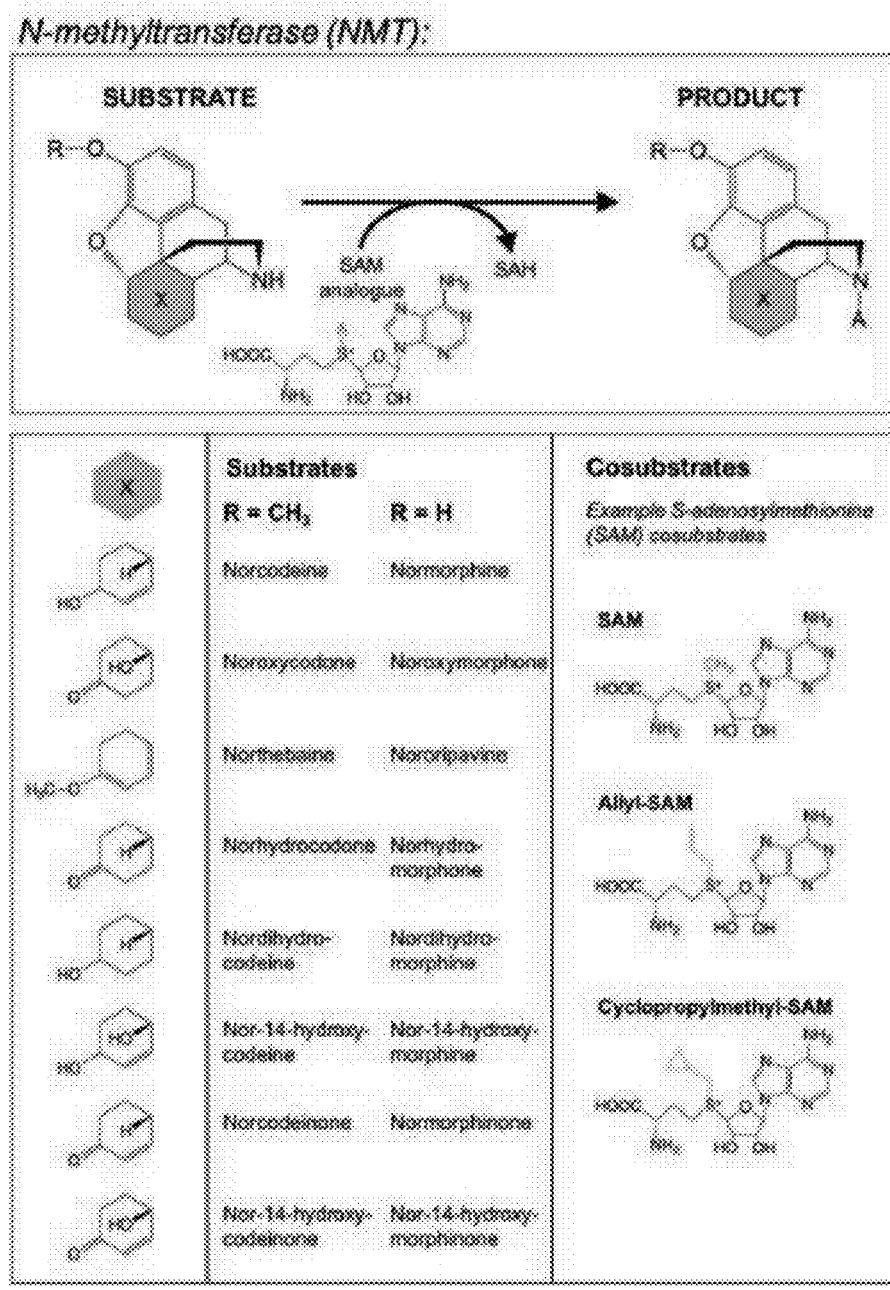
FIG. 8 illustrates an enzyme having N-methyltransferase activity, in accordance with embodiments of the invention.

FIG. 8 illustrates an enzyme having N-methyltransferase (NMT) activity, in accordance with embodiments of the invention. Specifically, the enzyme may act on any morphinan alkaloid structure to add a methyl group or other carbon moiety to the nitrogen. S-Adenosyl methionine (SAM) may act as the donor of the functional group (methyl, allyl, cyclopropylmethyl, or other).

Examples of amino acid sequences of NMT enzymes are set forth in Table 6. An amino acid sequence for an NMT that is utilized in converting a first alkaloid to a second alkaloid may be 75% or more identical to a given amino acid sequence as listed in Table 6. For example, an amino acid sequence for such an epimerase may comprise an amino acid sequence that is at least 75% or more, 80% or more, 81% or more, 82% or more, 83% or more, 84% or more, 85% or more, 86% or more, 87% or more, 88% or more, 89% or more, 90% or more, 91% or more, 92% or more, 93% or more, 94% or more, 95% or more, 96% or more, 97% or more, 98% or more, or 99% or more identical to an amino acid sequence as provided herein. Additionally, in certain embodiments, an "identical" amino acid sequence contains at least 80%-99% identity at the amino acid level to the specific amino acid sequence. In some cases an "identical" amino acid sequence contains at least about 85%, 86%, 87%, 88%, 89%, 90%, 91%, 92%, 93%, 94% and more in certain cases, at least 95%, 96%, 97%, 98% and 99% identity, at the amino acid level. In some cases, the amino acid sequence may be identical but the DNA sequence is altered such as to optimize codon usage for the host organism, for example.

An engineered host cell may be provided that produces an NMT that converts a first alkaloid to a second alkaloid, wherein the NMT comprises an amino acid sequence as provided in Table 6. An engineered host cell may be provided that produces one or more NMT enzymes. The NMT that is produced within the engineered host cell may be recovered and purified so as to form a biocatalyst. The process may include contacting the first alkaloid with an NMT in an amount sufficient to convert said first alkaloid to a second alkaloid. In examples, the first alkaloid may be contacted with a sufficient amount of the one or more enzymes such that at least 5% of said first alkaloid is converted to a second alkaloid. In further examples, the first alkaloid may be contacted with a sufficient amount of the one or more enzymes such that at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 82%, at least 84%, at least 86%, at least 88%, at least 90%, at least 91%, at least 92%, at least 93%, at least 94%, at least 95%, at least 96%, at least 97%, at least 98%, at least 99%, at least 99.5%, at least 99.7%, or 100% of said first alkaloid is converted to a second alkaloid.

The one or more enzymes that may be used to convert a first alkaloid to a second alkaloid may contact the first alkaloid in vitro. Additionally, or alternatively, the one or more enzymes that may be used to convert a first alkaloid to a second alkaloid may contact the first alkaloid in vivo. In some examples, the one or more enzymes that may be used to convert a first alkaloid to a second alkaloid may be provided to a cell having the first alkaloid within. In some examples, the one or more enzymes that may be used to convert a first alkaloid to a second alkaloid may be produced within an engineered host cell.

In some examples, the methods provide for engineered host cells that produce an alkaloid product, wherein the N-methyltransferase of a substrate to a product may comprise a key step in the production of an alkaloid product. In some examples, the alkaloid produced is a nal-opioid. In still other embodiments, the alkaloid produced is derived from a nor-opioid or a nal-opioid. In another embodiment, a first alkaloid is an intermediate toward the product of the engineered host cell. In still other embodiments, the alkaloid product is selected from the group including naloxone, naltrexone, and nalmefene.

In some examples, the substrate alkaloid is an opioid selected from the group consisting of norcodeine, noroxycodone, northebaine, norhydrocodone, nordihydro-codeine, nor-14-hydroxy-codeine, norcodeinone, nor-14-hydroxy-codeinone, normorphine, noroxymorphone, nororipavine, norhydro-morphone, nordihydro-morphine, nor-14-hydroxy-morphine, normorphinone, and nor-14-hydroxy-morphinone. In some examples, the cosubstrate is S-adenosyl-methionine, allyl-S-adenosylmethionine, or cyclopropylmethyl-S-adenosylmethionine.

Heterologous Coding Sequences

In some instances, the engineered host cells harbor one or more heterologous coding sequences (such as two or more, three or more, four or more, five or more) which encode activity(ies) that enable the engineered host cells to produce desired enzymes of interest and/or BIAs of interest, e.g., as described herein. As used herein, the term "heterologous coding sequence" is used to indicate any polynucleotide that codes for, or ultimately codes for, a peptide or protein or its equivalent amino acid sequence, e.g., an enzyme, that is not normally present in the host organism and may be expressed in the host cell under proper conditions. As such, "heterologous coding sequences" includes multiple copies of coding sequences that are normally present in the host cell, such that the cell is expressing additional copies of a coding sequence that are not normally present in the cells. The heterologous coding sequences may be RNA or any type thereof, e.g., mRNA, DNA or any type thereof, e.g., cDNA, or a hybrid of RNA/DNA. Coding sequences of interest include, but are not limited to, full-length transcription units that include such features as the coding sequence, introns, promoter regions, 3'-UTRs, and enhancer regions.

In examples, the engineered host cells may comprise a plurality of heterologous coding sequences each encoding an enzyme, such as an enzyme listed in Table 3. In some examples, the plurality of enzymes encoded by the plurality of heterologous coding sequences may be distinct from each other. In some examples, some of the plurality of enzymes encoded by the plurality of heterologous coding sequences may be distinct from each other and some of the plurality of enzymes encoded by the plurality of heterologous coding sequences may be duplicate copies.

In some examples, the heterologous coding sequences may be operably connected. Heterologous coding sequences that are operably connected may be within the same pathway of producing a particular benzylisoquinoline alkaloid product and/or epimerase product. In some examples, the operably connected heterologous coding sequences may be directly sequential along the pathway of producing a particular benzylisoquinoline alkaloid product and/or epimerase product. In some examples, the operably connected heterologous coding sequences may have one or more native enzymes between one or more of the enzymes encoded by the plurality of heterologous coding sequences. In some examples, the heterologous coding sequences may have one or more heterologous enzymes between one or more of the enzymes encoded by the plurality of heterologous coding sequences. In some examples, the heterologous coding sequences may have one or more non-native enzymes between one or more of the enzymes encoded by the plurality of heterologous coding sequences.

The engineered host cells may also be modified to possess one or more genetic alterations to accommodate the heterologous coding sequences. Alterations of the native host genome include, but are not limited to, modifying the genome to reduce or ablate expression of a specific protein that may interfere with the desired pathway. The presence of such native proteins may rapidly convert one of the intermediates or final products of the pathway into a metabolite or other compound that is not usable in the desired pathway. Thus, if the activity of the native enzyme were reduced or altogether absent, the produced intermediates would be more readily available for incorporation into the desired product.

Heterologous coding sequences include but are not limited to sequences that encode enzymes, either wild-type or equivalent sequences, that are normally responsible for the production of BIAs of interest in plants. In some cases, the enzymes for which the heterologous sequences code may be any of the enzymes in the 1-benzylisoquinoline alkaloid pathway, and may be from any convenient source. The choice and number of enzymes encoded by the heterologous coding sequences for the particular synthetic pathway may be selected based upon the desired product. In certain embodiments, the host cells of the invention may include 1 or more, 2 or more, 3 or more, 4 or more, 5 or more, 6 or more, 7 or more, 8 or more, 9 or more, 10 or more, 11 or more, 12 or more, 13 or more, 14 or more, or even 15 or more heterologous coding sequences, such as 1, 2, 3, 4, 5, 6, 7, 8, 9, 10, 11, 12, 13, 14, or 15 heterologous coding sequences.

As used herein, the term "heterologous coding sequences" also includes the coding portion of the peptide or enzyme, i.e., the cDNA or mRNA sequence, of the peptide or enzyme, as well as the coding portion of the full-length transcriptional unit, i.e., the gene including introns and exons, as well as "codon optimized" sequences, truncated sequences or other forms of altered sequences that code for the enzyme or code for its equivalent amino acid sequence, provided that the equivalent amino acid sequence produces a functional protein. Such equivalent amino acid sequences may have a deletion of one or more amino acids, with the deletion being N-terminal, C-terminal, or internal. Truncated forms are envisioned as long as they have the catalytic capability indicated herein. Fusions of two or more enzymes are also envisioned to facilitate the transfer of metabolites in the pathway, provided that catalytic activities are maintained.

Operable fragments, mutants, or truncated forms may be identified by modeling and/or screening. In some cases, this is achieved by deletion of, for example, N-terminal, C-terminal, or internal regions of the protein in a step-wise fashion, followed by analysis of the resulting derivative with regard to its activity for the desired reaction compared to the original sequence. If the derivative in question operates in this capacity, it is considered to constitute an equivalent derivative of the enzyme proper.

In examples, some heterologous proteins may show occurrences where they are incorrectly processed when expressed in a recombinant host. For example, plant proteins such as cytochrome P450 enzymes expressed in microbial production hosts may have occurrences of incorrect processing. In particular, salutaridine synthase may undergo N-linked glycosylation when heterologously expressed in yeast. This N-linked glycosylation may not be observed in plants, which may be indicative of incorrect N-terminal sorting of the nascent SalSyn transcript so as to reduce the activity of the enzyme in the heterologous microbial host. In such examples, protein engineering directed at correcting N-terminal sorting of the nascent transcript so as to remove the N-linked glycosylation pattern may result in improved activity of the salutaridine synthase enzyme in the recombinant production host.

Aspects of the invention also relate to heterologous coding sequences that code for amino acid sequences that are equivalent to the native amino acid sequences for the various enzymes. An amino acid sequence that is "equivalent" is defined as an amino acid sequence that is not identical to the specific amino acid sequence, but rather contains at least some amino acid changes (deletions, substitutions, inversions, insertions, etc.) that do not essentially affect the biological activity of the protein as compared to a similar activity of the specific amino acid sequence, when used for a desired purpose. The biological activity refers to, in the example of an epimerase, its catalytic activity. Equivalent sequences are also meant to include those which have been engineered and/or evolved to have properties different from the original amino acid sequence. Mutable properties of interest include catalytic activity, substrate specificity, selectivity, stability, solubility, localization, etc.

In some instances, the expression of each type of enzyme is increased through additional gene copies (i.e., multiple copies), which increases intermediate accumulation and/or BIA of interest production. Embodiments of the invention include increased BIA of interest production in a host cell through simultaneous expression of multiple species variants of a single or multiple enzymes. In some cases, additional gene copies of a single or multiple enzymes are included in the host cell. Any convenient methods may be utilized including multiple copies of a heterologous coding sequence for an enzyme in the host cell.

In some examples, the engineered host cell includes multiple copies of a heterologous coding sequence for an enzyme, such as 2 or more, 3 or more, 4 or more, 5 or more, or even 10 or more copies. In certain embodiments, the engineered host cell includes multiple copies of heterologous coding sequences for one or more enzymes, such as multiple copies of two or more, three or more, four or more, etc. In some cases, the multiple copies of the heterologous coding sequence for an enzyme are derived from two or more different source organisms as compared to the host cell. For example, the engineered host cell may include multiple copies of one heterologous coding sequence, where each of the copies is derived from a different source organism. As such, each copy may include some variations in explicit sequences based on inter-species differences of the enzyme of interest that is encoded by the heterologous coding sequence.

In certain embodiments, the engineered host cell includes multiple copies of heterologous coding sequences for one or more enzymes, such as multiple copies of two or more, three or more, four or more, etc. In some cases, the multiple copies of the heterologous coding sequence for an enzyme are derived from two or more different source organisms as compared to the host cell. For example, the engineered host cell may include multiple copies of one heterologous coding sequence, where each of the copies is derived from a different source organism. As such, each copy may include some variations in explicit sequences based on inter-species differences of the enzyme of interest that is encoded by the heterologous coding sequence.

The engineered host cell medium may be sampled and monitored for the production of BIAs of interest. The BIAs of interest may be observed and measured using any convenient methods. Methods of interest include, but are not limited to, LC-MS methods (e.g., as described herein) where a sample of interest is analyzed by comparison with a known amount of a standard compound. Additionally, there are other ways that BIAs of interest may be observed and/or measured. Examples of alternative ways of observing and/or measuring BIAs include GC-MS, UV-vis spectroscopy, NMR, LC-NMR, LC-UV, TLC, capillary electrophoresis, among others. Identity may be confirmed, e.g., by m/z and MS/MS fragmentation patterns, MRM transitions, and quantitation or measurement of the compound may be achieved via LC trace peaks of know retention time and/or EIC MS peak analysis by reference to corresponding LC-MS analysis of a known amount of a standard of the compound. In some cases, identity may be confirmed via multiple reaction monitoring using mass spectrometry.

Additionally, a culture of the engineered host cell may be sampled and monitored for the production of enzymes of interest, such as a DRS-DRR enzyme. The enzymes of interest may be observed and measured using any convenient methods. Methods of interest include enzyme activity assays, polyacrylamide gel electrophoresis, carbon monoxide spectroscopy, and western blot analysis.

Methods
Methods for Culturing Host Cells for BIA Production

As summarized above, some aspects of the invention include methods of preparing benzylisoquinoline alkaloids (BIAs) of interest. Additionally, some aspects of the invention include methods of preparing enzymes of interest. As such, some aspects of the invention include culturing an engineered host cell under conditions in which the one or more host cell modifications (e.g., as described herein) are functionally expressed such that the cell converts starting compounds of interest into product enzymes and/or BIAs of interest. Also provided are methods that include culturing an engineered host cell under conditions suitable for protein production such that one or more heterologous coding sequences are functionally expressed and convert starting compounds of interest into product enzymes or BIAs of interest. In examples, the method is a method of preparing a benzylisoquinoline alkaloid (BIA) that includes culturing an engineered host cell (e.g., as described herein); adding a starting compound to the cell culture; and recovering the BIA from the cell culture. In some examples, the method is a method of preparing an enzyme that includes culturing an engineered host cell (e.g., as described herein); adding a starting compound to the cell culture; and recovering the enzyme from the cell culture.

Fermentation media may contain suitable carbon substrates. The source of carbon suitable to perform the methods of this disclosure may encompass a wide variety of carbon containing substrates. Suitable substrates may include, without limitation, monosaccharides (e.g., glucose, fructose, galactose, xylose), oligosaccharides (e.g., lactose, sucrose, raffinose), polysaccharides (e.g., starch, cellulose), or a combination thereof. In some cases, unpurified mixtures from renewable feedstocks may be used (e.g., cornsteep liquor, sugar beet molasses, barley malt). In some cases, the carbon substrate may be a one-carbon substrate (e.g., methanol, carbon dioxide) or a two-carbon substrate (e.g., ethanol). In other cases, other carbon containing compounds may be utilized, for example, methylamine, glucosamine, and amino acids.

Any convenient methods of culturing engineered host cells may be employed for producing the enzymes and/or BIAs of interest. The particular protocol that is employed may vary, e.g., depending on the engineered host cell, the heterologous coding sequences, the enzymes of interest, the BIAs of interest, etc. The cells may be present in any convenient environment, such as an environment in which the cells are capable of expressing one or more functional heterologous enzymes. In some embodiments, the cells are cultured under conditions that are conducive to enzyme expression and with appropriate substrates available to allow production of enzymes and/or BIAs of interest in vivo. In some embodiments, the functional enzymes are extracted from the engineered host for production of enzymes and/or BIAs of interest under in vitro conditions. In some instances, the engineered host cells are placed back into a multicellular host organism. The engineered host cells are in any phase of growth, including, but not limited to, stationary phase and log-growth phase, etc. In addition, the cultures themselves may be continuous cultures or they may be batch cultures.

Cells may be grown in an appropriate fermentation medium at a temperature between 14-40° C. Cells may be grown with shaking at any convenient speed (e.g., 200 rpm). Cells may be grown at a suitable pH. Suitable pH ranges for the fermentation may be between pH 5-9. Fermentations may be performed under aerobic, anaerobic, or microaerobic conditions. Any suitable growth medium may be used. Suitable growth media may include, without limitation, common commercially prepared media such as synthetic defined (SD) minimal media or yeast extract peptone dextrose (YEPD) rich media. Any other rich, defined, or synthetic growth media appropriate to the microorganism may be used.

Cells may be cultured in a vessel of essentially any size and shape. Examples of vessels suitable to perform the methods of this disclosure may include, without limitation, multi-well shake plates, test tubes, flasks (baffled and non-baffled), and bioreactors. The volume of the culture may range from 10 microliters to greater than 10,000 liters.

The addition of agents to the growth media that are known to modulate metabolism in a manner desirable for the production of alkaloids may be included. In a non-limiting example, cyclic adenosine 2'3'-monophosphate may be added to the growth media to modulate catabolite repression.

Any convenient cell culture conditions for a particular cell type may be utilized. In certain embodiments, the host cells that include one or more modifications are cultured under standard or readily optimized conditions, with standard cell culture media and supplements. As one example, standard growth media when selective pressure for plasmid maintenance is not required may contain 20 g/L yeast extract, 10 g/L peptone, and 20 g/L dextrose (YPD). Host cells containing plasmids are grown in synthetic complete (SC) media containing 1.7 g/L yeast nitrogen base, 5 g/L ammonium sulfate, and 20 g/L dextrose supplemented with the appropriate amino acids required for growth and selection. Alternative carbon sources which may be useful for inducible enzyme expression include, but are not limited to, sucrose, raffinose, and galactose. Cells are grown at any convenient temperature (e.g., 30° C.) with shaking at any convenient rate (e.g., 200 rpm) in a vessel, e.g., in test tubes or flasks in volumes ranging from 1-1000 mL, or larger, in the laboratory.

Culture volumes may be scaled up for growth in larger fermentation vessels, for example, as part of an industrial process. The industrial fermentation process may be carried out under closed-batch, fed-batch, or continuous chemostat conditions, or any suitable mode of fermentation. In some cases, the cells may be immobilized on a substrate as whole cell catalysts and subjected to fermentation conditions for alkaloid production.

A batch fermentation is a closed system, in which the composition of the medium is set at the beginning of the fermentation and not altered during the fermentation process. The desired organism(s) are inoculated into the medium at the beginning of the fermentation. In some instances, the batch fermentation is run with alterations made to the system to control factors such as pH and oxygen concentration (but not carbon). In this type of fermentation system, the biomass and metabolite compositions of the system change continuously over the course of the fermentation. Cells typically proceed through a lag phase, then to a log phase (high growth rate), then to a stationary phase (growth rate reduced or halted), and eventually to a death phase (if left untreated). In additional cases, the batch fermentation system may be opened at certain times to add additional substrates for fermentating the desired organism. In particular, in some cases, a fermentation system may include a fed batch reactor.

A continuous fermentation is an open system, in which a defined fermentation medium is added continuously to the bioreactor and an equal amount of fermentation media is continuously removed from the vessel for processing. Continuous fermentation systems are generally operated to maintain steady state growth conditions, such that cell loss due to medium being removed must be balanced by the growth rate in the fermentation. Continuous fermentations are generally operated at conditions where cells are at a constant high cell density. Continuous fermentations allow for the modulation of one or more factors that affect target product concentration and/or cell growth.

The liquid medium may include, but is not limited to, a rich or synthetic defined medium having an additive component described above. Media components may be dissolved in water and sterilized by heat, pressure, filtration, radiation, chemicals, or any combination thereof. Several media components may be prepared separately and sterilized, and then combined in the fermentation vessel. The culture medium may be buffered to aid in maintaining a constant pH throughout the fermentation.

Process parameters including temperature, dissolved oxygen, pH, stirring, aeration rate, and cell density may be monitored or controlled over the course of the fermentation. For example, temperature of a fermentation process may be monitored by a temperature probe immersed in the culture medium. The culture temperature may be controlled at the set point by regulating the jacket temperature. Water may be cooled in an external chiller and then flowed into the bioreactor control tower and circulated to the jacket at the temperature required to maintain the set point temperature in the vessel.

Additionally, a gas flow parameter may be monitored in a fermentation process. For example, gases may be flowed into the medium through a sparger. Gases suitable for the methods of this disclosure may include compressed air, oxygen, and nitrogen. Gas flow may be at a fixed rate or regulated to maintain a dissolved oxygen set point.

The pH of a culture medium may also be monitored. In examples, the pH may be monitored by a pH probe that is immersed in the culture medium inside the vessel. If pH control is in effect, the pH may be adjusted by acid and base pumps which add each solution to the medium at the required rate. The acid solutions used to control pH may be sulfuric acid or hydrochloric acid. The base solutions used to control pH may be sodium hydroxide, potassium hydroxide, or ammonium hydroxide.

Further, dissolved oxygen may be monitored in a culture medium by a dissolved oxygen probe immersed in the culture medium. If dissolved oxygen regulation is in effect, the oxygen level may be adjusted by increasing or decreasing the stirring speed. The dissolved oxygen level may also be adjusted by increasing or decreasing the gas flow rate. The gas may be compressed air, oxygen, or nitrogen.

Stir speed may also be monitored in a fermentation process. In examples, the stirrer motor may drive an agitator. The stirrer speed may be set at a consistent rpm throughout the fermentation or may be regulated dynamically to maintain a set dissolved oxygen level.

Additionally, turbidity may be monitored in a fermentation process. In examples, cell density may be measured using a turbidity probe. Alternatively, cell density may be measured by taking samples from the bioreactor and analyzing them in a spectrophotometer. Further, samples may be removed from the bioreactor at time intervals through a sterile sampling apparatus. The samples may be analyzed for alkaloids produced by the host cells. The samples may also be analyzed for other metabolites and sugars, the depletion of culture medium components, or the density of cells.

In another example, a feed stock parameter may be monitored during a fermentation process. In particular, feed stocks including sugars and other carbon sources, nutrients, and cofactors that may be added into the fermentation using an external pump. Other components may also be added during the fermentation including, without limitation, antifoam, salts, chelating agents, surfactants, and organic liquids.

Any convenient codon optimization techniques for optimizing the expression of heterologous polynucleotides in host cells may be adapted for use in the subject host cells and methods, see e.g., Gustafsson, C. et al. (2004) *Trends Biotechnol,* 22, 346-353, which is incorporated by reference in its entirety.

The subject method may also include adding a starting compound to the cell culture. Any convenient methods of addition may be adapted for use in the subject methods. The cell culture may be supplemented with a sufficient amount of the starting materials of interest (e.g., as described herein), e.g., a mM to μM amount such as between about 1-5 mM of a starting compound. It is understood that the amount of starting material added, the timing and rate of addition, the form of material added, etc., may vary according to a variety of factors. The starting material may be added neat or pre-dissolved in a suitable solvent (e.g., cell culture media, water, or an organic solvent). The starting material may be added in concentrated form (e.g., 10× over desired concentration) to minimize dilution of the cell culture medium upon addition. The starting material may be added in one or more batches, or by continuous addition over an extended period of time (e.g., hours or days).

Methods for Isolating Products from the Fermentation Medium

The subject methods may also include recovering the enzymes and/or BIAs of interest from the cell culture. Any convenient methods of separation and isolation (e.g., chromatography methods or precipitation methods) may be adapted for use in the subject methods to recover the enzymes and/or BIAs of interest from the cell culture. Filtration methods may be used to separate soluble from insoluble fractions of the cell culture. In some cases, liquid chromatography methods (e.g., reverse phase HPLC, size exclusion, normal phase chromatography) may be used to separate the BIA of interest from other soluble components of the cell culture. In some cases, extraction methods (e.g., liquid extraction, pH based purification, solid phase extraction, affinity chromatography, ion exchange, etc.) may be used to separate the enzymes and/or BIAs of interest from other components of the cell culture.

The produced alkaloids may be isolated from the fermentation medium using methods known in the art. A number of recovery steps may be performed immediately after (or in some instances, during) the fermentation for initial recovery of the desired product. Through these steps, the alkaloids (e.g., BIAs) may be separated from the cells, cellular debris and waste, and other nutrients, sugars, and organic molecules may remain in the spent culture medium. This process may be used to yield a BIA-enriched product.

In an example, a product stream having a benzylisoquinoline alkaloid (BIA) product is formed by providing engineered yeast cells and a feedstock including nutrients and water to a batch reactor. In particular, the engineered yeast cells may be subjected to fermentation by incubating the engineered yeast cells for a time period of at least about 5 minutes to produce a solution comprising the BIA product and cellular material. Once the engineered yeast cells have been subjected to fermentation, at least one separation unit may be used to separate the BIA product from the cellular material to provide the product stream comprising the BIA product. In particular, the product stream may include the BIA product as well as additional components, such as a clarified yeast culture medium. Additionally, a BIA product may comprise one or more BIAs of interest, such as one or more BIA compounds.

Different methods may be used to remove cells from a bioreactor medium that include an enzyme and/or BIA of interest. In examples, cells may be removed by sedimentation over time. This process of sedimentation may be accelerated by chilling or by the addition of fining agents such as silica. The spent culture medium may then be siphoned from the top of the reactor or the cells may be decanted from the base of the reactor. Alternatively, cells may be removed by filtration through a filter, a membrane, or other porous material. Cells may also be removed by centrifugation, for example, by continuous flow centrifugation or by using a continuous extractor.

If some valuable enzymes and/or BIAs of interest are present inside the cells, the cells may be permeabilized or lysed and the cell debris may be removed by any of the methods described above. Agents used to permeabilize the cells may include, without limitation, organic solvents (e.g., DMSO) or salts (e.g., lithium acetate). Methods to lyse the cells may include the addition of surfactants such as sodium dodecyl sulfate, or mechanical disruption by bead milling or sonication.

Enzymes and/or BIAs of interest may be extracted from the clarified spent culture medium through liquid-liquid extraction by the addition of an organic liquid that is immiscible with the aqueous culture medium. In examples, the use of liquid-liquid extraction may be used in addition to other processing steps. Examples of suitable organic liquids include, but are not limited to, isopropyl myristate, ethyl acetate, chloroform, butyl acetate, methylisobutyl ketone, methyl oleate, toluene, oleyl alcohol, ethyl butyrate. The organic liquid may be added to as little as 10% or as much as 100% of the aqueous medium. The organic liquid may be as little as 10%, may be 100%, may be 200%, may be 300%, may be 400%, may be 500%, may be 600%, may be 700%, may be 800%, may be 900%, may be 1000%, may be more than 1000%, or may be a percentage in between those listed herein of the volume of the aqueous liquid.

In some cases, the organic liquid may be added at the start of the fermentation or at any time during the fermentation. This process of extractive fermentation may increase the yield of enzymes and/or BIAs of interest from the host cells by continuously removing enzymes and/or BIAs to the organic phase.

Agitation may cause the organic phase to form an emulsion with the aqueous culture medium. Methods to encourage the separation of the two phases into distinct layers may include, without limitation, the addition of a demulsifier or a nucleating agent, or an adjustment of the pH. The emulsion may also be centrifuged to separate the two phases, for example, by continuous conical plate centrifugation.

Alternatively, the organic phase may be isolated from the aqueous culture medium so that it may be physically removed after extraction. For example, the solvent may be encapsulated in a membrane.

In examples, enzymes and/or BIAs of interest may be extracted from a fermentation medium using adsorption methods. In examples, BIAs of interest may be extracted from clarified spent culture medium by the addition of a resin such as Amberlite® XAD4 or another agent that removes BIAs by adsorption. The BIAs of interest may then be released from the resin using an organic solvent. Examples of suitable organic solvents include, but are not limited to, methanol, ethanol, ethyl acetate, or acetone.

BIAs of interest may also be extracted from a fermentation medium using filtration. At high pH, the BIAs of interest may form a crystalline-like precipitate in the bioreactor. This precipitate may be removed directly by filtration through a filter, membrane, or other porous material. The precipitate may also be collected by centrifugation and/or decantation.

The extraction methods described above may be carried out either in situ (in the bioreactor) or ex situ (e.g., in an external loop through which media flows out of the bioreactor and contacts the extraction agent, then is recirculated back into the vessel). Alternatively, the extraction methods may be performed after the fermentation is terminated using the clarified medium removed from the bioreactor vessel.

Methods for Purifying Products from Alkaloid-Enriched Solutions

Subsequent purification steps may involve treating the post-fermentation solution enriched with BIA product(s) of interest using methods known in the art to recover individual product species of interest to high purity.

In one example, BIAs of interest extracted in an organic phase may be transferred to an aqueous solution. In some cases, the organic solvent may be evaporated by heat and/or vacuum, and the resulting powder may be dissolved in an aqueous solution of suitable pH. In a further example, the BIAs of interest may be extracted from the organic phase by addition of an aqueous solution at a suitable pH that promotes extraction of the BIAs of interest into the aqueous phase. The aqueous phase may then be removed by decantation, centrifugation, or another method.

The BIA-containing solution may be further treated to remove metals, for example, by treating with a suitable chelating agent. The BIA of interest-containing solution may be further treated to remove other impurities, such as proteins and DNA, by precipitation. In one example, the BIA of interest-containing solution is treated with an appropriate precipitation agent such as ethanol, methanol, acetone, or isopropanol. In an alternative example, DNA and protein may be removed by dialysis or by other methods of size exclusion that separate the smaller alkaloids from contaminating biological macromolecules.

In further examples, the solution containing BIAs of interest may be extracted to high purity by continuous cross-flow filtration using methods known in the art.

If the solution contains a mixture of BIAs of interest, it may be subjected to acid-base treatment to yield individual BIA of interest species using methods known in the art. In this process, the pH of the aqueous solution is adjusted to precipitate individual BIAs.

For high purity, small-scale preparations, the BIAs may be purified in a single step by liquid chromatography.

Liquid Chromatography Mass Spectrometry (LCMS) Method

The BIA compounds of interest, including 1-benzylisoquinoline alkaloids, bisbenzylisoquinoline alkaloids, promorphinan alkaloids, morphinan alkaloids, nal-opioids, and nor-opioids, may be separated using liquid chromatography, and detected and quantified using mass spectrometry. Compound identity may be confirmed by characteristic elution time, mass-to-charge ratio (m/z) and fragmentation patterns (MS/MS). Quantitation may be performed by comparison of compound peak area to a standard curve of a known reference standard compound. Additionally, BIAs of interest may be detected by alternative methods such as GC-MS, UV-vis spectroscopy, NMR, LC-NMR, LC-UV, TLC, and capillary electrophoresis.

Purpald Assay Method

For high throughput screening of demethylation reactions a purpald assay may be used. For example, demethylation catalyzed by 2-oxoglutarate dependent dioxygenases produces formaldehyde a as product as shown in the generalized chemical equation: [substrate]+2-oxoglutarate+$O_2$ [product]+formaldehyde+succinate+$CO_2$. Purpald reagent in alkaline conditions undergoes a color change in the presence of formaldehyde that can be quantified to concentrations as low as 1 nM with a spectrophotometer at 510 nm.

Yeast-Derived Alkaloid APIs Versus Plant-Derived APIs

The clarified yeast culture medium (CYCM) may contain a plurality of impurities. The clarified yeast culture medium may be dehydrated by vacuum and/or heat to yield an alkaloid-rich powder. This product is analogous to the concentrate of poppy straw (CPS) or opium, which is exported from poppy-growing countries and purchased by API manufacturers. For the purposes of this invention, CPS is a representative example of any type of purified plant extract from which the desired alkaloids product(s) may ultimately be further purified. Table 10 and Table 11 highlight the impurities in these two products that may be specific to either CYCM or CPS or may be present in both. While some BIAs may have a pigment as an impurity, other BIAs may be categorized as pigments themselves. Accordingly, these BIAs may be assessed for impurities based on non-pigment impurities. By analyzing a product of unknown origin for a subset of these impurities, a person of skill in the art could determine whether the product originated from a yeast or plant production host.

API-grade pharmaceutical ingredients are highly purified molecules. As such, impurities that could indicate the plant- or yeast-origin of an API (such as those listed in Table 10 and Table 11) may not be present at the API stage of the product. Indeed, many of the API products derived from yeast strains of the present invention may be largely indistinguishable from the traditional plant-derived APIs. In some cases, however, conventional alkaloid compounds may be subjected to chemical modification using chemical synthesis approaches, which may show up as chemical impurities in plant-based products that require such chemical modifications. For example, chemical derivatization may often result in a set of impurities related to the chemical synthesis processes. In certain situations, these modifications may be performed biologically in the yeast production platform, thereby avoiding some of the impurities associated with chemical derivation from being present in the yeast-derived product. In particular, these impurities from the chemical derivation product may be present in an API product that is produced using chemical synthesis processes but may be absent from an API product that is produced using a yeast-derived product. Alternatively, if a yeast-derived product is mixed with a chemically-derived product, the resulting impurities may be present but in a lesser amount than would be expected in an API that only or primarily contains chemically-derived products. In this example, by analyzing the API product for a subset of these impurities, a person of skill in the art could determine whether the product originated from a yeast production host or the traditional chemical derivatization route.

Non-limiting examples of impurities that may be present in chemically-derivatized morphinan APIs but not in biosynthesized APIs include a codeine-O(6)-methyl ether impurity in API codeine; 8,14-dihydroxy-7,8-dihydrocodeinone in API oxycodone; and tetrahydrothebaine in API hydrocodone. The codeine-O(6)-methyl ether may be formed by chemical over-methylation of morphine. The 8,14-dihydroxy-7,8-dihydrocodeinone in API oxycodone may be formed by chemical over-oxidation of thebaine. Additionally, the tetrahydrothebaine in API hydrocodone may be formed by chemical over-reduction of thebaine.

However, in the case where the yeast-derived compound and the plant-derived compound are both subjected to chemical modification through chemical synthesis approaches, the same impurities associated with the chemical synthesis process may be expected in the products. In such a situation, the starting material (e.g., CYCM or CPS) may be analyzed as described above.

Host Cell Derived Nal-Opioids Vs Chemically Derived Nal-Opioids

Nal-opioids produced by chemical synthesis may contain a plurality of impurities. These impurities may arise from many different causes, for example, unreacted starting materials, incomplete reactions, the formation of byproducts, persistence of intermediates, dimerization, or degradation. An example of an unreacted starting material could be oxymorphone remaining in a preparation of naltrexone. An example of an impurity arising from an incomplete reaction could be 3-O-Methylbuprenorphine resulting from the incomplete 3-O-demethylation of thebaine. Chemical modification can result in the addition or removal of functional groups at off-target sites. For example, the oxidation of C10 to create 10-hydroxynaltrexone and 10-ketonaltrexone during naltrexone synthesis, or the removal of the 6-O-methyl group to give 6-O-desmethylbuprenorphine during buprenorphine synthesis. Impurites may arise from the persistence of reaction intermediates, for example the persistence of N-oxides like oxymorphone N-oxide formed during the N-demethylation process. Another source of impurities is dimerization, the conjugation of two opioid molecules, for example two buprenorphine molecules (2,2'-bisbuprenorphine), two naltrexone molecules (2,2'-bisnaltrexone), or two naloxone molecules (2,2'-bisnaloxone). Impurities may arise from degradation of starting materials, reaction intermediates, or reaction products. The extreme physical conditions used in chemical syntheses may make the presence of degradation more likely. An example of an impurity that may arise from degradation is dehydrobuprenorphine produced by oxidizing conditions during buprenorphine synthesis.

Nal-opioids produced by enzyme catalysis in a host cell may contain different impurities than nal-opioids produced by chemical synthesis. Nal-opioids produced by enzyme catalysis in a host cell may contain fewer impurities than nal-opioids produced by chemical synthesis. Nal-opioids produced by enzyme catalysis in a host cell may lack certain impurities that are found in nal-opioids produced by chemical synthesis. In examples, key features of enzyme synthesis may include, (1) enzymes target a specific substrate and residue with high fidelity; (2) enzymes perform reactions in the mild physiological conditions within the cell which do not compromise the stability of the molecules; and (3) enzymes are engineered to be efficient catalysts that drive reactions to completion.

Table 12 highlights some of the impurities that may be specific to chemically produced nal-opioids. Accordingly, nal-opioids may be assessed for impurities to determine the presence or absence of any impurity from Table 12. By analyzing a product of unknown origin for a subset of these impurities, a person of skill in the art could determine whether the product originated from a chemical or enzymatic synthesis.

Methods of Engineering Host Cells

Also included are methods of engineering host cells for the purpose of producing enzymes and/or BIAs of interest. Inserting DNA into host cells may be achieved using any convenient methods. The methods are used to insert the heterologous coding sequences into the engineered host cells such that the host cells functionally express the enzymes and convert starting compounds of interest into product enzymes and/or BIAs of interest.

Any convenient promoters may be utilized in the subject engineered host cells and methods. The promoters driving expression of the heterologous coding sequences may be constitutive promoters or inducible promoters, provided that the promoters are active in the engineered host cells. The heterologous coding sequences may be expressed from their native promoters, or non-native promoters may be used. Such promoters may be low to high strength in the host in which they are used. Promoters may be regulated or constitutive. In certain embodiments, promoters that are not glucose repressed, or repressed only mildly by the presence of glucose in the culture medium, are used. Promoters of interest include but are not limited to, promoters of glycolytic genes such as the promoter of the *B. subtilis* tsr gene (encoding the promoter region of the fructose bisphosphate aldolase gene) or the promoter from yeast *S. cerevisiae* gene coding for glyceraldehyde 3-phosphate dehydrogenase (GPD, GAPDH, or TDH3), the ADH1 promoter of baker's yeast, the phosphate-starvation induced promoters such as the PHO5 promoter of yeast, the alkaline phosphatase promoter from *B. licheniformis*, yeast inducible promoters such as Gal1-10, Gal1, GalL, GalS, repressible promoter Met25, tetO, and constitutive promoters such as glyceraldehyde 3-phosphate dehydrogenase promoter (GPD), alcohol dehydrogenase promoter (ADH), translation-elongation factor-1-α promoter (TEF), cytochrome c-oxidase promoter (CYC1), MRP7 promoter, etc. Autonomously replicating yeast expression vectors containing promoters inducible by hormones such as glucocorticoids, steroids, and thyroid hormones may also be used and include, but are not limited to, the glucorticoid responsive element (GRE) and thyroid hormone responsive element (TRE). These and other examples are described in U.S. Pat. No. 7,045,290, which is incorporated by reference, including the references cited therein. Additional vectors containing constitutive or inducible promoters such as a factor, alcohol oxidase, and PGH may be used. Additionally any promoter/enhancer combination (as per the Eukaryotic Promoter Data Base EPDB) could also be used to drive expression of genes. Any convenient appropriate promoters may be selected for the host cell, e.g., *E. coli*. One may also use promoter selection to optimize transcript, and hence, enzyme levels to maximize production while minimizing energy resources.

Figure 11:
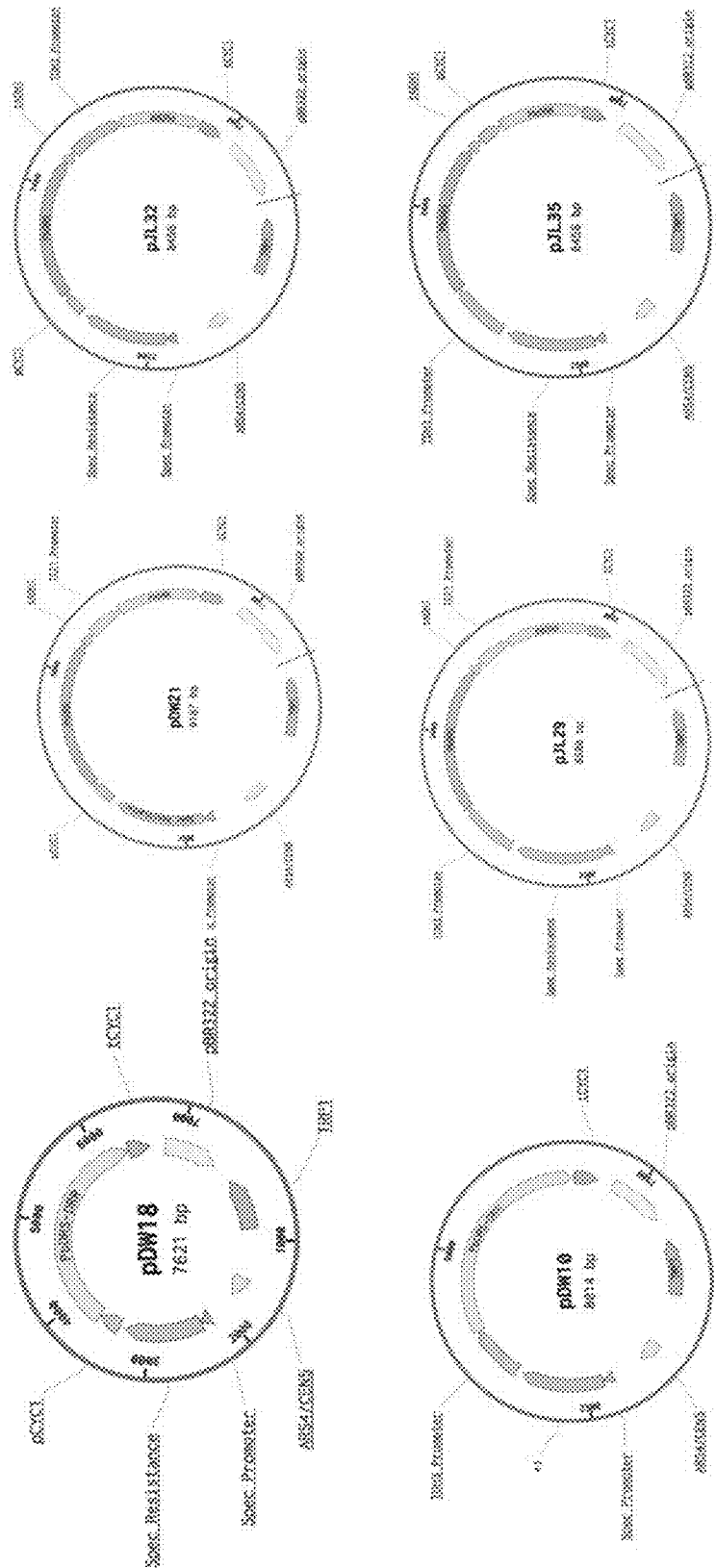
FIG. 11 illustrates plasmid/YAC vectors comprising codon-optimized amino acid sequence of DRS-DRR and DRS and DRR enzymes for enzyme expression and engineering, in accordance with embodiments of the invention.

Any convenient vectors may be utilized in the subject engineered host cells and methods. Vectors of interest include vectors for use in yeast and other cells. The types of yeast vectors may be broken up into 4 general categories: integrative vectors (YIp), autonomously replicating high copy-number vectors (YEp or 2 plasmids), autonomously replicating low copy-number vectors (YCp or centromeric plasmids) and vectors for cloning large fragments (YACs). Vector DNA is introduced into prokaryotic or eukaryotic cells via any convenient transformation or transfection techniques. DNA of another source (e.g. PCR-generated double stranded DNA product, or synthesized double stranded or single stranded oligonucleotides) may be used to engineer the yeast by integration into the genome. Any single transformation event may include one or several nucleic acids (vectors, double stranded or single stranded DNA fragments) to genetically modify the host cell. FIG. 11 illustrates examples of convenient vectors. Further, Table 8 provides examples of base plasmid sequences from which portions of sequences represented in FIG. 11 may be derived. In some embodiments, plasmid sequences in Table 8 may be utilized in integrating aspects of embodiments disclosed herein.

Utility

The engineered host cells and methods of the invention, e.g., as described above, find use in a variety of applications. Applications of interest include, but are not limited to: research applications and therapeutic applications. Methods of the invention find use in a variety of different applications including any convenient application where the production of enzymes and/or BIAs is of interest.

The subject engineered host cells and methods find use in a variety of therapeutic applications. Therapeutic applications of interest include those applications in which the preparation of pharmaceutical products that include BIAs is of interest. The engineered host cells described herein produce BIAs of interest and enzymes of interest. Reticuline is a major branch point intermediate of interest in the synthesis of BIAs including engineering efforts to produce end products such as opioid products. The subject host cells may be utilized to produce BIAs of interest from simple and inexpensive starting materials that may find use in the production of BIAs of interest, including reticuline, and BIA end products. As such, the subject host cells find use in the supply of therapeutically active BIAs of interest.

In some instances, the engineered host cells and methods find use in the production of commercial scale amounts of BIAs thereof where chemical synthesis of these compounds is low yielding and not a viable means for large-scale production. In certain cases, the host cells and methods are utilized in a fermentation facility that would include bioreactors (fermenters) of e.g., 5,000-200,000 liter capacity allowing for rapid production of BIAs of interest thereof for therapeutic products. Such applications may include the industrial-scale production of BIAs of interest from fermentable carbon sources such as cellulose, starch, and free sugars.

The subject engineered host cells and methods find use in a variety of research applications. The subject host cells and methods may be used to analyze the effects of a variety of enzymes on the biosynthetic pathways of a variety of enzymes and/or BIAs of interest. In addition, the engineered host cells may be engineered to produce enzymes and/or BIAs of interest that find use in testing for bioactivity of interest in as yet unproven therapeutic functions. In some cases, the engineering of host cells to include a variety of heterologous coding sequences that encode for a variety of enzymes elucidates the high yielding biosynthetic pathways towards enzymes and/or BIAs of interest. In certain cases, research applications include the production of enzymes and/or BIAs of interest for therapeutic molecules of interest that may then be further chemically modified or derivatized to desired products or for screening for increased therapeutic activities of interest. In some instances, host cell strains are used to screen for enzyme activities that are of interest in such pathways, which may lead to enzyme discovery via conversion of BIA metabolites produced in these strains.

The subject engineered host cells and methods may be used as a production platform for plant specialized metabolites. The subject host cells and methods may be used as a platform for drug library development as well as plant enzyme discovery. For example, the subject engineered host cells and methods may find use in the development of natural product based drug libraries by taking yeast strains producing interesting scaffold molecules, such as guattegaumerine, and further functionalizing the compound structure through combinatorial biosynthesis or by chemical means. By producing drug libraries in this way, any potential drug hits are already associated with a production host that is amenable to large-scale culture and production. As another example, these subject engineered host cells and methods may find use in plant enzyme discovery. The subject host cells provide a clean background of defined metabolites to express plant EST libraries to identify new enzyme activities. The subject host cells and methods provide expression methods and culture conditions for the functional expression and increased activity of plant enzymes in yeast.

Kits and Systems

Aspects of the invention further include kits and systems, where the kits and systems may include one or more components employed in methods of the invention, e.g., engineered host cells, starting compounds, heterologous coding sequences, vectors, culture medium, etc., as described herein. In some embodiments, the subject kit includes an engineered host cell (e.g., as described herein), and one or more components selected from the following: starting compounds, a heterologous coding sequence and/or a vector including the same, vectors, growth feedstock, components suitable for use in expression systems (e.g., cells, cloning vectors, multiple cloning sites (MCS), bi-directional promoters, an internal ribosome entry site (IRES), etc.), and a culture medium.

Any of the components described herein may be provided in the kits, e.g., host cells including one or more modifications, starting compounds, culture medium, etc. A variety of components suitable for use in making and using heterologous coding sequences, cloning vectors and expression systems may find use in the subject kits. Kits may also include tubes, buffers, etc., and instructions for use. The various reagent components of the kits may be present in separate containers, or some or all of them may be pre-combined into a reagent mixture in a single container, as desired.

Also provided are systems for producing enzymes and/or BIAs of interest, where the systems may include engineered host cells including one or more modifications (e.g., as described herein), starting compounds, culture medium, a fermenter and fermentation equipment, e.g., an apparatus suitable for maintaining growth conditions for the host cells, sampling and monitoring equipment and components, and the like. A variety of components suitable for use in large scale fermentation of yeast cells may find use in the subject systems.

In some cases, the system includes components for the large scale fermentation of engineered host cells, and the monitoring and purification of enzymes and/or BIA compounds produced by the fermented host cells. In certain embodiments, one or more starting compounds (e.g., as described herein) are added to the system, under conditions by which the engineered host cells in the fermenter produce one or more desired BIA products of interest. In some instances, the host cells produce a BIA of interest (e.g., as described herein). In certain cases, the BIA products of interest are opioid products, such as thebaine, codeine, neopine, morphine, neomorphine, hydrocodone, oxycodone, hydromorphone, dihydrocodeine, 14-hydroxycodeine, dihydromorphine, and oxymorphone. In some cases, the BIA products of interest are nal-opioids, such as naltrexone, naloxone, nalmefene, nalorphine, nalorphine, nalodeine, naldemedine, naloxegol, 6β-naltrexol, naltrindole, methylnaltrexone, methylsamidorphan, alvimopan, axelopran, bevenpran, dinicotinate, levallorphan, samidorphan, buprenorphine, dezocine, eptazocine, butorphanol, levorphanol, nalbuphine, pentazocine, phenazocine, norbinaltorphimine, and diprenorphine. In some cases, the BIA products of interest are nor-opioids, such as norcodeine, noroxycodone, northebaine, norhydrocodone, nordihydro-codeine, nor-14-hydroxy-codeine, norcodeinone, nor-14-hydroxy-codeinone, normorphine, noroxymorphone, nororipavine, norhydro-morphone, nordihydro-morphine, nor-14-hydroxy-morphine, normorphinone, and nor-14-hydroxy-morphinone. In some cases, the BIA products are bisbenzylisoquinoline products, such as berbamunine, guattegaumerine, dauricine, and liensinine.

In some cases, the system includes processes for monitoring and or analyzing one or more enzymes and/or BIAs of interest compounds produced by the subject host cells. For example, a LC-MS analysis system as described herein, a chromatography system, or any convenient system where the sample may be analyzed and compared to a standard, e.g., as described herein. The fermentation medium may be monitored at any convenient times before and during fermentation by sampling and analysis. When the conversion of starting compounds to enzymes and/or BIA products of interest is complete, the fermentation may be halted and purification of the BIA products may be done. As such, in some cases, the subject system includes a purification component suitable for purifying the enzymes and/or BIA products of interest from the host cell medium into which it is produced. The purification component may include any convenient means that may be used to purify the enzymes and/or BIA products of interest produced by fermentation, including but not limited to, silica chromatography, reverse-phase chromatography, ion exchange chromatography, HIC chromatography, size exclusion chromatography, liquid extraction, and pH extraction methods. In some cases, the subject system provides for the production and isolation of enzyme and/or BIA fermentation products of interest following the input of one or more starting compounds to the system.

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.), but some experimental errors and deviations should be accounted for. Unless indicated otherwise, parts are parts by weight, molecular weight is weight average molecular weight, temperature is in degrees Centigrade, and pressure is at or near atmospheric.

Discussion of Enzyme List

The host cells may be engineered to include one or more modifications (such as two or more, three or more, four or more, five or more, or even more modifications) that provide for the production of BIAs of interest and/or enzymes of interest. Table 3 provides a list of exemplary genes that may be acted upon by one or more modifications so as to provide for the production of BIAs of interest and/or enzymes of interest in an engineered host cell.

Modifications of genes as provided in Table 3 may be used to produce BIAs of interest from engineered host cells that are supplied with a medium containing the minimal nutrients required for growth. This minimal medium may contain a carbon source, a nitrogen source, amino acids, vitamins, and salts. For example, modifications of genes as provided in Table 3 may be used to produce BIAs of interest from engineered host cells that are fed sugar. Additionally, modifications of one or more genes as provided in Table 3 may be used to augment the biosynthetic processes of host cells that may be engineered for drug production.

Additionally, the use of these modifications to provide for the production of BIAs of interest and/or enzymes of interest in engineered host cells is not readily apparent from the mere identification of enzymes that may be produced by the genes. In particular, synthetic pathways that have been reconstructed in host cells, such as yeast cells, as described herein comprise a variety of enzymes that do not act together in nature within a single organism. Additionally, some of the enzymes discussed herein do not act for BIA biosynthesis in their natural context. Further, some of the enzymes described herein are not evolved to function in particular host cells, such as yeast cells, and are not evolved to function together. In these cases, it would not be obvious that the enzymes would exhibit sufficient activity in the context of the synthetic BIA pathway in a host cell, such as yeast, to have sufficient flux through the pathway to produce downstream BIA end products.

For example, plant enzymes are often difficult to functionally express in heterologous microbial hosts, such as yeast. In many cases the enzymes may be misfolded, not correctly localized within the host cell, and/or incorrectly processed. The differences in protein translation and processing between yeast and plants can lead to these enzymes exhibiting substantially reduced to no detectable activities in the yeast host. These challenges arise commonly for endomembrane localized enzymes, such as cytochrome P450s, which are strongly represented in the BIA pathways. Even reduced enzyme activities may pose a substantial challenge to engineering yeast to produce complex BIAs, which requires sufficient activity at each step to ensure high-level accumulation of the desired BIA products.

Additionally, there are endogenous enzymes/pathways in some host cells, such as yeast, that may act on many of the early precursors in the BIA pathway (i.e., intermediates from tyrosine to norcoclaurine), and thus it may not be readily apparent that there would be sufficient flux through the heterologous pathway to achieve substantial BIA production given these competing endogenous pathways. For example, the Erlich pathway (Hazelwood, et al. 2008. Appl. Environ. Microbiol. 74: 2259-66; Larroy, et al. 2003. Chem. Biol. Interact. 143-144: 229-38; Larroy, et al. 2002. Eur. J. Biochem. 269: 5738-45) in yeast is the main endogenous pathway that would act to convert many of the intermediates in the early BIA pathway to undesired products and divert flux from the synthetic pathway.

Further, many of the enzymes as discussed herein, and as provided in Table 3, may function under very specific regulation strategies, including spatial regulation, in the native plant hosts, which may be lost upon transfer to the heterologous yeast host. In addition, plants present very different biochemical environments than yeast cells under which the enzymes are evolved to function, including pH, redox state, and substrate, cosubstrate, coenzyme, and cofactor availabilities. Given the differences in biochemical environments and regulatory strategies between the native hosts and the heterologous yeast hosts, it is not obvious that the enzymes would exhibit substantial activities when in the context of the yeast environment and further not obvious that they would work together to direct simple precursors such as sugar to complex BIA compounds. Maintaining the activities of the enzymes in the yeast host is particularly important as many of the pathways have many reaction steps (>10), such that if these steps are not efficient then one would not expect accumulation of desired downstream products.

In addition, in the native plant hosts, the associated metabolites in these pathways may be localized across different cell and tissue types. In several examples, there are cell types that may be specialized for biosynthesis and cell types that may be synthesized for metabolite accumulation. This type of cell specialization may be lost when expressing the pathways within a heterologous yeast host, and may play an important role in controlling the toxicity of these metabolites on the cells. Thus, it is not obvious that yeast could be successfully engineered to biosynthesize and accumulate these metabolites without being harmed by the toxicity of these compounds.

As one example, in the native plant hosts, the enzyme BBE is reported to have dynamic subcellular localization. In particular, the enzyme BBE initially starts in the ER and then is sorted to the vacuole (Bird and Facchini. 2001. Planta. 213: 888-97). It has been suggested that the ER-association of BBE in plants (Alcantara, et al. 2005. Plant Physiol. 138: 173-83) provides the optimal basic pH (pH ~8.8) for BBE activity (Ziegler and Facchini. 2008. Annu. Rev. Plant Biol. 59: 735-69). As another example, there is evidence that sanguinarine biosynthesis occurs in specialized vesicles within plant cells (Amann, et al. 1986. Planta. 167: 310-20), but only some of the intermediates accumulate in the vesicles. This may occur so as to sequester them from other enzyme activities and/or toxic effects.

As another example, the biosynthetic enzymes in the morphinan pathway branch are all localized to the phloem, which is part of the vascular tissue in plants. In the phloem, the pathway enzymes may be further divided between two cell types: the sieve elements common to all plants, and the laticifer which is a specialized cell type present only in certain plants which make specialized secondary metabolites. The upstream enzymes (i.e., from NCS through to SalAT) are predominantly in the sieve elements, and the downstream enzymes (i.e., T6ODM, COR, CODM) are mostly in the laticifer (Onoyovwe, et al. 2013. Plant Cell. 25: 4110-22). Additionally, it was discovered that the final steps in the noscapine biosynthetic pathway take place in the laticifer (Chen and Facchini. 2014. Plant J. 77: 173-84). This compartmentalization is thought to be highly important for regulating biosynthesis by isolating or trafficking intermediates, providing optimal pH, enhancing supply of cofactors, although the nature of the poppy laticifer microenvironment is still under investigation (Ziegler and Facchini. 2008. Annu. Rev. Plant Biol. 59: 735-69). Further, it is predicted that several of the enzymes may function as multi-enzyme complexes or metabolic channels common to plant secondary metabolism (Kempe, et al. 2009. Phytochemistry. 70: 579-89; Allen, et al. 2004. Nat. Biotechnol. 22: 1559-66). When biosynthetic enzymes are combined from different hosts and/or expressed recombinantly in a heterologous yeast cell it is not clear that these complexes or channels will form as they would in the native host. In an additional example, in *Coptis japonica*, berberine is biosynthesized in root tissues and then accumulated within the rhizome via the action of specialized ATP-binding cassette transport proteins (Shitan, et al. 2013. Phytochemistry. 91: 109-16). In opium poppy, morphinan alkaloids are accumulated within the latex (cytoplasm of laticifer cells) (Martin, et al. 1967. Biochemistry. 6: 2355-63).

Further, even without these considerations, it is also the case that the plant enzymes for several of the steps in the pathways described herein have not yet been characterized. For example, the conversion of tyrosine to the early benzylisoquinoline alkaloid scaffold norcoclaurine has not yet been characterized. Thus, for several of the steps in the pathways described herein, alternative biosynthetic scheme were produced by bringing together enzyme activities that do not normally occur together in nature for the biosynthesis of BIAs or identifying new enzyme activities from genome sequence information to use in the reconstructed pathways.

For example, the two-step conversion of tyrosine to dopamine may be achieved by combining at least 5 mammalian enzymes and 1 bacterial enzyme, which do not naturally occur together and were not evolved to function in the context of this pathway or with plant enzymes. In these instances, it may not be obvious to utilize these enzymes for the biosynthesis of compounds they were not evolved for in nature and that they would function effectively in the context of a heterologous microbial host and this pathway.

As another example, until recent years the enzyme responsible for the conversion of (S)-reticuline to (R)-reticuline was unknown. Even when a fused epimerase enzyme was discovered, evolutionary analysis suggested that morphine-producing poppies evolved a fusion enzyme between the oxidase and reductase for an epimerase reaction, which was in contrast to non-morphine producing poppies where the epimerase enzymes were non-fused. Based on this analysis, some scholars believed the fusion of the oxidase and reductase portions was necessary to efficiently catalyze the conversion of (S)-reticuline to (R)-reticuline. Novel methods of using engineered split epimerases as discussed herein may perform this epimerization reaction in yeast and in the context of the synthetic BIA pathway, and may perform this epimerization with greater efficiency than performing an epimerization with a wild-type epimerase.

Examples of the genes that are the object of modifications so as to produce BIAs of interest and/or enzymes of interest are discussed below. Additionally, the genes are discussed in the context of a series of Figures that illustrate pathways that are used in generating BIAs of interest and/or enzymes of interest.

[TKL1] In some examples, the engineered host cell may modify the expression of the enzyme transketolase. Transketolase is encoded by the TKL1 gene. In examples, transketolase catalyzes the reaction of fructose-6-phosphate+glyceraldehyde-3-phosphate⇌+xylulose-5-phosphate+erythrose-4-phosphate, as referenced in FIG. 2. An engineered host cell may be modified to include constitutive overexpression of the TKL1 gene in the engineered host cell. Additionally or alternatively, the engineered host cell may be modified to synthetically regulate the expression of the TKL1 gene in the engineered host cell. In examples, the engineered host cell may be modified to incorporate a copy, copies, or additional copies, of the TKL1 gene. Additionally or alternatively, the engineered host cell may be modified to incorporate the introduction of a strong promoter element for the overexpression of the TKL1 gene within the engineered host cell. The TKL1 gene may be derived from *Saccharomyces cerevisiae* or another species. In some examples, the TKL1 gene may be 100% similar to the naturally occurring gene.

[ZWF1] In some examples, the engineered host cell may modify the expression of the enzyme glucose-6-phosphate dehydrogenase. Glucose-6-phosphate dehydrogenase is encoded by the ZWF1 gene. In examples, glucose-6-phosphate dehydrogenase catalyzes the reaction of glucose-6-phosphate→6-phosphogluconolactone, as referenced in FIG. 2. An engineered host cell may be modified to delete the coding region of the ZWF1 gene in the engineered host cell. Alternatively, the engineered host cell may be modified to disable the functionality of the ZWF1 gene, such as by introducing an inactivating mutation.

[ARO4] In some examples, the engineered host cell may modify the expression of the enzyme 3-deoxy-D-arabino-heptulosonate-7-phosphate (DAHP) synthase. DAHP synthase is encoded by the ARO4 gene. In examples, DAHP synthase catalyzes the reaction of erythrose-4-phosphate+phosphoenolpyruvic acid→DAHP, as referenced in FIG. 2. An engineered host cell may modify the ARO4 gene to incorporate one or more feedback inhibition alleviating mutations. In particular, a feedback inhibition alleviating mutation (e.g., ARO4$^{FBR}$) may be incorporated as a directed mutation to a native ARO4 gene at the original locus; as an additional copy introduced as a genetic integration at a separate locus; or as an additional copy on an episomal vector such as a 2 μm or centromeric plasmid. The identifier "FBR" in the mutation ARO4$^{FBR}$ refers to feedback resistant mutants and mutations. The feedback inhibited copy of the DAHP synthase enzyme may be under a native yeast transcriptional regulation, such as when the engineered host cell is a yeast cell. Alternatively, the feedback inhibited copy of the DAHP synthase enzyme may be introduced to the engineered host cell with engineered constitutive or dynamic regulation of protein expression by placing it under the control of a synthetic promoter. In some cases, the ARO4 gene may be derived from *Saccharomyces cerevisiae*. In some cases, the ARO4 gene may be 100% similar to the naturally occurring gene. Examples of modifications to the ARO4 gene include a feedback inhibition resistant mutation, K229L, or Q166K.

[ARO7] In some examples, the engineered host cell may modify the expression of the enzyme chorismate mutase. Chorismate mutase is encoded by the ARO7 gene. In examples, chorismate mutase catalyzes the reaction of chorismate→prephenate, as referenced in FIG. 2. An engineered host cell may modify the ARO7 gene to incorporate one or more feedback inhibition alleviating mutations. In particular, a feedback inhibition alleviating mutation (e.g., ARO7$^{FBR}$) may be incorporated as a directed mutation to a native ARO7 gene at the original locus; as an additional copy introduced as a genetic integration at a separate locus; or as an additional copy on an episomal vector such as a 2-μm or centromeric plasmid. The identifier "FBR" in the mutation ARO7$^{FBR}$ refers to feedback resistant mutants and mutations. The feedback inhibited copy of the chorismate mutase enzyme may be under a native yeast transcriptional regulation, such as when the engineered host cell is a yeast cell. Alternatively, the feedback inhibited copy of the chorismate mutase enzyme may be introduced to the engineered host cell with engineered constitutive or dynamic regulation of protein expression by placing it under the control of a synthetic promoter. In some cases, the ARO7 gene may be derived from *Saccharomyces cerevisiae*. In some cases, the ARO7 gene may be 100% similar to the naturally occurring gene. Examples of modifications to the ARO7 gene include a feedback inhibition resistant mutation or T226I.

[ARO10] In some examples, the engineered host cell may modify the expression of the enzyme phenylpyruvate decarboxylase. Phenylpyruvate decarboxylase is encoded by the ARO10 gene. In examples, phenylpyruvate decarboxylase catalyzes the reaction of hydroxyphenylpyruvate→4-hydroxyphenylacetate (4HPA), as referenced in FIG. 2. An engineered host cell may be modified to include constitutive overexpression of the ARO10 gene in the engineered host cell. Additionally or alternatively, the engineered host cell may be modified to synthetically regulate the expression of the ARO10 gene in the engineered host cell. In examples, the engineered host cell may be modified to incorporate a copy, copies, or additional copies, of the ARO10 gene. Additionally or alternatively, the engineered host cell may be modified to incorporate the introduction of a strong promoter element for the overexpression of the ARO10 gene within the engineered host cell. The ARO10 gene may be derived from *Saccharomyces cerevisiae* or another species. In some examples, the ARO10 gene may be 100% similar to the naturally occurring gene.

[ADH2-7, SFA1] In some examples, the engineered host cell may modify the expression of alcohol dehydrogenase enzymes. Alcohol dehydrogenase enzymes may be encoded by one or more of the ADH2, ADH3, ADH4, ADH5, ADH6, ADH7, and SFA1 genes. In examples, alcohol dehydrogenase catalyzes the reaction of 4HPA→tyrosol. An engineered host cell may be modified to delete the coding region of one or more of the ADH2, ADH3, ADH4, ADH5, ADH6, ADH7, and SFA1 genes in the engineered host cell. Alternatively, the engineered host cell may be modified to disable the functionality of one or more of the ADH2, ADH3, ADH4, ADH5, ADH6, ADH7, and SFA1 genes, such as by introducing an inactivating mutation.

[ALD2-6] In some examples, the engineered host cell may modify the expression of aldehyde oxidase enzymes. Aldehyde oxidase enzymes may be encoded by one or more of the ALD2, ALD3, ALD4, ALD5, and ALD6 genes. In examples, aldehyde oxidase catalyzes the reaction of 4HPA→hydroxyphenylacetic acid. An engineered host cell may be modified to delete the coding region of one or more of the ALD2, ALD3, ALD4, ALD5, and ALD6 genes in the engineered host cell. Alternatively, the engineered host cell may be modified to disable the functionality of one or more of the ALD2, ALD3, ALD4, ALD5, and ALD6 genes, such as by introducing an inactivating mutation.

[AAD4], [AAD6], [AAD10], [AAD14], [AAD15], [AAD16] In some examples, the engineered host cell may modify the expression of aryl-alcohol dehydrogenase enzymes. Aryl-alcohol dehydrogenase enzymes may be encoded by one or more of AAD4, AAD6, AAD10, AAD14, AAD15, and AAD16 genes. In examples, aryl-alcohol dehydrogenase catalyzes the reaction of aromatic aldehyde+NAD$^+$-aromatic alcohol+NADH.

[ARO9] In some examples, the engineered host cell may modify the expression of the enzyme aromatic aminotransferase. Aromatic aminotransferase is encoded by the ARO9 gene. In examples, aromatic aminotransferase catalyzes the reaction of hydroxyphenylpyruvate+L-alanine⇌tyrosine+pyruvate, as referenced in FIG. 2. An engineered host cell may be modified to include constitutive overexpression of the ARO9 gene in the engineered host cell. Additionally or alternatively, the engineered host cell may be modified to synthetically regulate the expression of the ARO9 gene in the engineered host cell. In examples, the engineered host cell may be modified to incorporate a copy, copies, or additional copies, of the ARO9 gene. Additionally or alternatively, the engineered host cell may be modified to incorporate the introduction of a strong promoter element for the overexpression of the ARO9 gene within the engineered host cell. The ARO9 gene may be derived from *Saccharomyces cerevisiae* or another species. In some examples, the ARO9 gene may be 100% similar to the naturally occurring gene.

[ARO8] In some examples, the engineered host cell may modify the expression of the enzyme aromatic aminotransferase. Aromatic aminotransferase is encoded by the ARO8 gene. In examples, aromatic aminotransferase catalyzes the reaction of hydroxyphenylpyruvate+glutamate⇌tyrosine+alpha-ketogluterate, as referenced in FIG. 2. An engineered host cell may be modified to include constitutive overexpression of the ARO8 gene in the engineered host cell. Additionally or alternatively, the engineered host cell may be modified to synthetically regulate the expression of the ARO8 gene in the engineered host cell. In examples, the engineered host cell may be modified to incorporate a copy, copies, or additional copies, of the ARO8 gene. Additionally or alternatively, the engineered host cell may be modified to incorporate the introduction of a strong promoter element for the overexpression of the ARO8 gene within the engineered host cell. The ARO8 gene may be derived from *Saccharomyces cerevisiae* or another species. In some examples, the ARO8 gene may be 100% similar to the naturally occurring gene.

[TYR1] In some examples, the engineered host cell may modify the expression of the enzyme prephenate dehydrogenase. Prephenate dehydrogenase is encoded by the TYR1 gene. In examples, prephenate dehydrogenase catalyzes the reaction of prephenate+NADP$^+$→4-hydroxyphenylpyruvate+CO$_2$+NADPH, as referenced in FIG. 2. An engineered host cell may be modified to include constitutive overexpression of the TYR1 gene in the engineered host cell. Additionally or alternatively, the engineered host cell may be modified to synthetically regulate the expression of the TYR1 gene in the engineered host cell. In examples, the engineered host cell may be modified to incorporate a copy, copies, or additional copies, of the TYR1 gene. Additionally or alternatively, the engineered host cell may be modified to incorporate the introduction of a strong promoter element for the overexpression of the TYR1 gene within the engineered host cell. The TYR1 gene may be derived from *Saccharomyces cerevisiae* or another species. In some examples, the TYR1 gene may be 100% similar to the naturally occurring gene.

[TYR] In some examples, the engineered host cell may modify the expression of the enzyme tyrosinase. Tyrosinase is encoded by the TYR gene. In examples, tyrosinase catalyzes the reaction of tyrosine→L-DOPA, as referenced in FIGS. 2, 12, and 13. In other examples, tyrosinase catalyzes the reaction of L-DOPA→dopaquinone. An engineered host cell may be modified to include constitutive expression of the TYR gene in the engineered host cell. Additionally or alternatively, the engineered host cell may be modified to synthetically regulate the expression of the TYR gene in the engineered host cell. In examples, the engineered host cell may be modified to incorporate a copy, copies, or additional copies, of the TYR gene. Additionally or alternatively, the engineered host cell may be modified to incorporate the introduction of a strong promoter element for the overexpression of the TYR gene within the engineered host cell. The TYR gene may be derived from *Ralstonia solanacearum, Agaricus bisporus*, or another species. In some examples, the TYR gene may be 100% similar to the naturally occurring gene.

[TyrH] In some examples, the engineered host cell may modify the expression of the enzyme tyrosine hydroxylase. Tyrosine hydroxylase is encoded by the TyrH gene. In examples, tyrosine hydroxylase catalyzes the reaction of tyrosine→L-DOPA, as referenced in FIGS. 2, 12, and 13. An engineered host cell may be modified to include constitutive expression of the TyrH gene in the engineered host cell.

Additionally or alternatively, the engineered host cell may be modified to synthetically regulate the expression of the TyrH gene in the engineered host cell. In examples, the engineered host cell may be modified to incorporate a copy, copies, or additional copies, of the TyrH gene. Additionally or alternatively, the engineered host cell may be modified to incorporate the introduction of a strong promoter element for the overexpression of the TyrH gene within the engineered host cell. The TyrH gene may be derived from *Homo sapiens, Rattus norvegicus, Mus musculus*, or another species. In some examples, the TyrH gene may be 100% similar to the naturally occurring gene.

[DODC] In some examples, the engineered host cell may modify the expression of the enzyme L-DOPA decarboxylase. L-DOPA decarboxylase is encoded by the DODC gene. In examples, L-DOPA decarboxylase catalyzes the reaction of L-DOPA→dopamine, as referenced in FIGS. 2, 12, and 13. An engineered host cell may be modified to include constitutive expression of the DODC gene in the engineered host cell. Additionally or alternatively, the engineered host cell may be modified to synthetically regulate the expression of the DODC gene in the engineered host cell. In examples, the engineered host cell may be modified to incorporate a copy, copies, or additional copies, of the DODC gene. Additionally or alternatively, the engineered host cell may be modified to incorporate the introduction of a strong promoter element for the overexpression of the DODC gene within the engineered host cell. The DODC gene may be derived from *Pseudomonas putida, Rattus norvegicus*, or another species. In some examples, the DODC gene may be 100% similar to the naturally occurring gene.

[TYDC] In some examples, the engineered host cell may modify the expression of the enzyme tyrosine/DOPA decarboxylase. Tyrosine/DOPA decarboxylase is encoded by the TYDC gene. In examples, tyrosine/DOPA decarboxylase catalyzes the reaction of L-DOPA→dopamine, as referenced in FIGS. 2, 12, and 13. An engineered host cell may be modified to include constitutive expression of the TYDC gene in the engineered host cell. Additionally or alternatively, the engineered host cell may be modified to synthetically regulate the expression of the TYDC gene in the engineered host cell. In examples, the engineered host cell may be modified to incorporate a copy, copies, or additional copies, of the TYDC gene. Additionally or alternatively, the engineered host cell may be modified to incorporate the introduction of a strong promoter element for the overexpression of the TYDC gene within the engineered host cell. The TYDC gene may be derived from *Papaver somniferum* or another species. In some examples, the TYDC gene may be 100% similar to the naturally occurring gene.

[MAO] In some examples, the engineered host cell may modify the expression of the enzyme monoamine oxidase. Monoamine oxidase is encoded by the MAO gene. In examples, monoamine oxidase catalyzes the reaction of dopamine→3,4-DHPA, as referenced in FIGS. 2 and 13. An engineered host cell may be modified to include constitutive expression of the MAO gene in the engineered host cell. Additionally or alternatively, the engineered host cell may be modified to synthetically regulate the expression of the MAO gene in the engineered host cell. In examples, the engineered host cell may be modified to incorporate a copy, copies, or additional copies, of the MAO gene. Additionally or alternatively, the engineered host cell may be modified to incorporate the introduction of a strong promoter element for the overexpression of the MAO gene within the engineered host cell. In some cases, the MAO gene may be codon optimized for expression in *Saccharomyces cerevisiae*. The MAO gene may be derived from *Escherichia coli, Homo sapiens, Micrococcus luteus*, or another species. In some examples, the MAO gene may be 77% similar to the naturally occurring gene.

Figure 12:
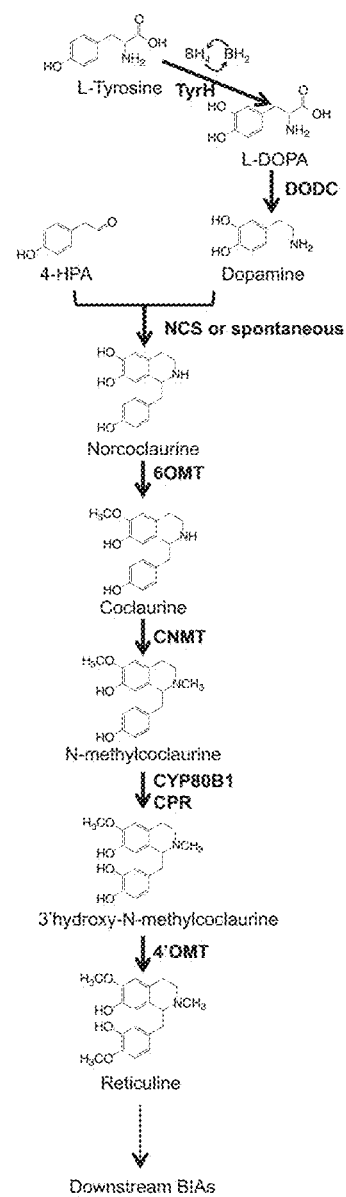
FIG. 12 illustrates a biosynthetic scheme for conversion of L-tyrosine to reticuline via norcoclaurine, in accordance with embodiments of the invention.

[NCS] In some examples, the engineered host cell may modify the expression of the enzyme norcoclaurine synthase. Norcoclaurine synthase is encoded by the NCS gene. In examples, norcoclaurine synthase catalyzes the reaction of 4HPA+dopamine→(S)-norcoclaurine, as referenced in FIGS. 12 and 13. In particular, FIG. 12 illustrates a biosynthetic scheme for conversion of L-tyrosine to reticuline via norcoclaurine, in accordance with embodiments of the invention. FIG. 12 provides the use of the enzymes TyrH, tyrosine hydroxylase; DODC, DOPA decarboxylase; NCS, norcoclaurine synthase, as discussed herein; 6OMT, 6-O-methyltransferase; CNMT, coclaurine N-methyltransferase; CYP80B1, cytochrome P450 80B1; CPR, cytochrome P450 NADPH reductase; 4'OMT, 3'hydroxy-N-methylcoclaurine 4'-O-methyltransferase. L-DOPA, L-3,4-dihydroxyphenylalanine; and 4-HPA, 4-hydroxyphenylacetylaldehyde. Of the enzymes that are illustrated in FIG. 12, 4-HPA and L-tyrosine are naturally synthesized in yeast. All other listed metabolites are not naturally produced in yeast. Additionally, although TyrH may catalyze the conversion of L-tyrosine to L-DOPA, other enzymes may also be used to perform this step as described in the specification. For example, tyrosinases may also be used to perform the conversion of L-tyrosine to L-DOPA. In addition, other enzymes such as cytochrome P450 oxidases may also be used to perform the conversion of L-tyrosine to L-DOPA. Such enzymes may exhibit oxidase activity on related BIA precursor compounds including L-DOPA and L-tyrosine.

Figure 13:
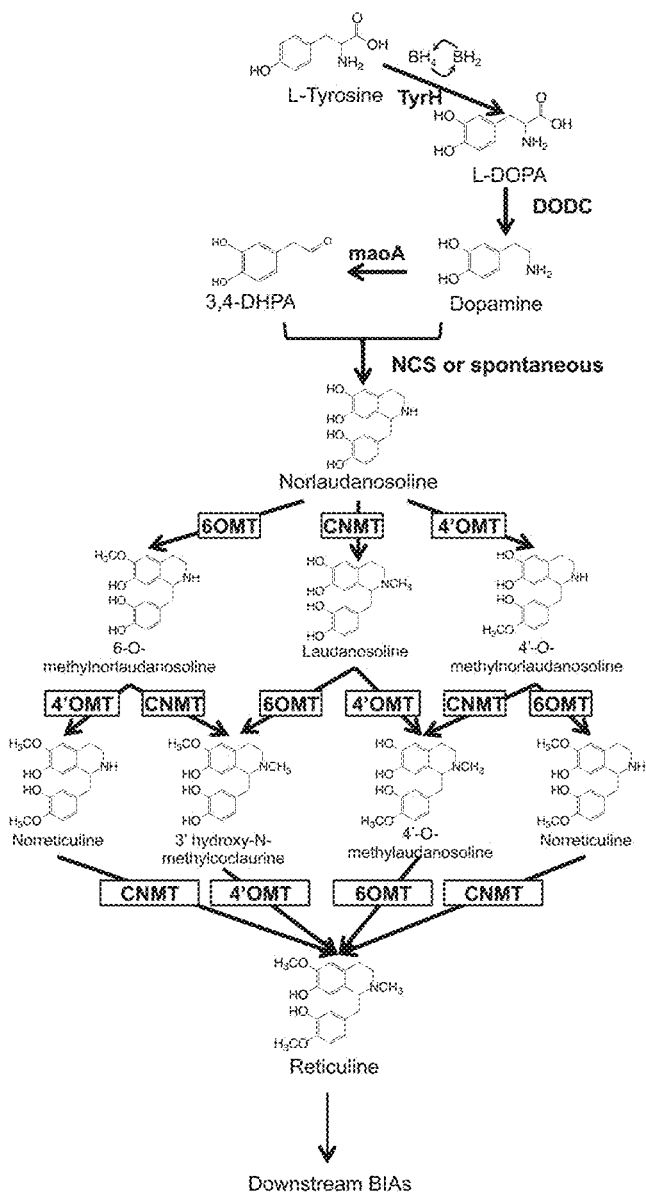
FIG. 13 illustrates a biosynthetic scheme for conversion of L-tyrosine to reticuline via norlaudanosoline, in accordance with embodiments of the invention.

Additionally, norcoclaurine synthase catalyzes the reaction of 3,4-DHPA+dopamine→(S)-norlaudanosoline, as referenced in FIG. 13. In particular, FIG. 13 illustrates a biosynthetic scheme for conversion of L-tyrosine to reticuline via norlaudanosoline, in accordance with embodiments of the invention. FIG. 13 provides the use of the enzymes TyrH, tyrosine hydroxylase; DODC, DOPA decarboxylase; maoA, monoamine oxidase; NCS, norcoclaurine synthase; 6OMT, 6-O-methyltransferase; CNMT, coclaurine N-methyltransferase; 4'OMT, 3'hydroxy-N-methylcoclaurine 4'-O-methyltransferase. L-DOPA, L-3,4-dihydroxyphenylalanine; and 3,4-DHPA, 3,4-dihydroxyphenylacetaldehyde. Of the enzymes that are illustrated in FIG. 13, L-tyrosine is naturally synthesized in yeast. Other metabolites that are shown in FIG. 13 are not naturally produced in yeast.

An engineered host cell may be modified to include constitutive expression of the NCS gene in the engineered host cell. Additionally or alternatively, the engineered host cell may be modified to synthetically regulate the expression of the NCS gene in the engineered host cell. In examples, the engineered host cell may be modified to incorporate a copy, copies, or additional copies, of the NCS gene. Additionally or alternatively, the engineered host cell may be modified to incorporate the introduction of a strong promoter element for the overexpression of the NCS gene within the engineered host cell. Additionally, the norcoclaurine synthase may have an N-terminal truncation. In some cases, the NCS gene may be codon optimized for expression in *Saccharomyces cerevisiae*. The NCS gene may be derived from *Coptis japonica, Papaver somniferum, Papver bracteatum, Thalicitum flavum, Corydalis saxicola*, or another species. In some examples, the NCS gene may be 80% similar to the naturally occurring gene.

[6OMT] In some examples, the engineered host cell may modify the expression of the enzyme norcoclaurine 6-O-methyltransferase. Norcoclaurine 6-O-methyltransferase is encoded by the 6OMT gene. In some examples, norcoclaurine 6-O-methyltransferase catalyzes the reaction of norcoclaurine→coclaurine, as referenced in FIG. 12. In other examples, norcoclaurine 6-O-methyltransferase catalyzes the reaction of norlaudanosoline→3'hydroxycoclaurine, as well as other reactions detailed herein, such as those provided in FIG. 13. Additionally, the engineered host cell may be modified to include constitutive expression of the 6OMT gene in the engineered host cell. Additionally or alternatively, the engineered host cell may be modified to synthetically regulate the expression of the 6OMT gene in the engineered host cell. In examples, the engineered host cell may be modified to incorporate a copy, copies, or additional copies, of the 6OMT gene. Additionally or alternatively, the engineered host cell may be modified to incorporate the introduction of a strong promoter element for the overexpression of the 6OMT gene within the engineered host cell. The 6OMT gene may be derived from *P. somniferum, T. flavum, Coptis japonica*, or another species. In some examples, the 6OMT gene may be 100% similar to the naturally occurring gene.

[CNMT] In some examples, the engineered host cell may modify the expression of the enzyme coclaurine-N-methyltransferase. Coclaurine-N-methyltransferase is encoded by the CNMT gene. In some examples, coclaurine-N-methyltransferase catalyzes the reaction of coclaurine→N-methylcoclaurine, as referenced in FIG. 12. In other examples, the coclaurine-N-methyltransferase enzyme may catalyze the reaction of 3'hydroxycoclaurine→3'hydroxy-N-methylcoclaurine. In other examples, coclaurine-N-methyltransferase may catalyze other reactions detailed herein, such as those provided in FIG. 13. Additionally, the engineered host cell may be modified to include constitutive expression of the CNMT gene in the engineered host cell. Additionally or alternatively, the engineered host cell may be modified to synthetically regulate the expression of the CNMT gene in the engineered host cell. In examples, the engineered host cell may be modified to incorporate a copy, copies, or additional copies, of the CNMT gene. Additionally or alternatively, the engineered host cell may be modified to incorporate the introduction of a strong promoter element for the overexpression of the CNMT gene within the engineered host cell. The CNMT gene may be derived from *P. somniferum, T. flavum, Coptis japonica*, or another species. In some examples, the CNMT gene may be 100% similar to the naturally occurring gene.

[4'OMT] In some examples, the engineered host cell may modify the expression of the enzyme 4'-O-methyltransferase. 4'-O-methyltransferase is encoded by the 4'OMT gene. In some examples, 4'-O-methyltransferase catalyzes the reaction of 3'-hydroxy-N-methylcoclaurine→reticuline, as referenced in FIG. 12. In other examples, 4'-O-methyltransferase catalyzes other reactions detailed herein, such as those provided in FIG. 13. Additionally, the engineered host cell may be modified to include constitutive expression of the 4'OMT gene in the engineered host cell. Additionally or alternatively, the engineered host cell may be modified to synthetically regulate the expression of the 4'OMT gene in the engineered host cell. In examples, the engineered host cell may be modified to incorporate a copy, copies, or additional copies, of the 4'OMT gene. Additionally or alternatively, the engineered host cell may be modified to incorporate the introduction of a strong promoter element for the overexpression of the 4'OMT gene within the engineered host cell. The 4'OMT gene may be derived from *P. somniferum, T. flavum, Coptis japonica*, or another species. In some examples, the 4'OMT gene may be 100% similar to the naturally occurring gene.

[CYP80B1] In some examples, the engineered host cell may modify the expression of the enzyme cytochrome P450 80B1. Cytochrome P450 80B1 is encoded by the CYP80B1 gene. In examples, cytochrome P450 80B1 catalyzes the reaction of N-methylcoclaurine→3'-hydroxy-N-methylcoclaurine, as referenced in FIG. 12. An engineered host cell may be modified to include constitutive expression of the cytochrome P450 80B1 gene in the engineered host cell. Additionally or alternatively, the engineered host cell may be modified to synthetically regulate the expression of the cytochrome P450 80B1 gene in the engineered host cell. In examples, the engineered host cell may be modified to incorporate a copy, copies, or additional copies, of the cytochrome P450 80B1 gene. Additionally or alternatively, the engineered host cell may be modified to incorporate the introduction of a strong promoter element for the overexpression of the cytochrome P450 80B1 gene within the engineered host cell. In some cases, the CYP80B1 gene may be codon optimized for expression in *Saccharomyces cerevisiae*. The cytochrome P450 80B1 gene may be derived from *P. somniferum, E. californica, T. flavum*, or another species. In some examples, the P450 80B1 gene may be 77% similar to the naturally occurring gene.

[FOL2] In some examples, the engineered host cell may modify the expression of the enzyme GTP cyclohydrolase. GTP cyclohydrolase is encoded by the FOL2 gene. In some examples, GTP cyclohydrolase catalyzes the reaction of GTP→dihydroneopterin triphosphate, as referenced in FIG. 1. The engineered host cell may be modified to include constitutive overexpression of the FOL2 gene in the engineered host cell. The engineered host cell may also be modified to include native regulation. Additionally or alternatively, the engineered host cell may be modified to synthetically regulate the expression of the FOL2 gene in the engineered host cell. In examples, the engineered host cell may be modified to incorporate a copy, copies, or additional copies, of the FOL2 gene. Additionally or alternatively, the engineered host cell may be modified to incorporate the introduction of a strong promoter element for the overexpression of the FOL2 gene within the engineered host cell. The FOL2 gene may be derived from *Saccharomyces cerevisiae, Homo sapiens, Mus musculus*, or another species. In some examples, the FOL2 gene may be 100% similar to the naturally occurring gene.

[PTPS] In some examples, the engineered host cell may modify the expression of the enzyme 6-pyruvoyl tetrahydrobiopterin (PTP) synthase. Pyruvoyl tetrahydrobiopterin synthase is encoded by the PTPS gene. In some examples, 6-pyruvoyl tetrahydrobiopterin synthase catalyzes the reaction of dihydroneopterin triphosphate→PTP, as referenced in FIG. 1. The engineered host cell may be modified to include constitutive expression of the PTPS gene in the engineered host cell. Additionally or alternatively, the engineered host cell may be modified to synthetically regulate the expression of the PTPS gene in the engineered host cell. In examples, the engineered host cell may be modified to incorporate a copy, copies, or additional copies, of the PTPS gene. Additionally or alternatively, the engineered host cell may be modified to incorporate the introduction of a strong promoter element for the overexpression of the PTPS gene within the engineered host cell. In some cases, the PTPS gene may be codon optimized for expression in *Saccharomyces cerevisiae*. The PTPS gene may be derived from *Rattus norvegicus, Homo sapiens, Mus musculus*, or another species. In some examples, the PTPS gene may be 80% similar to the naturally occurring gene.

[SepR] In some examples, the engineered host cell may modify the expression of the enzyme sepiapterin reductase. Sepiapterin reductase is encoded by the SepR gene. In some examples, sepiapterin reductase catalyzes the reaction of PTP→BH$_4$, as referenced in FIG. 1. The engineered host cell may be modified to include constitutive expression of the SepR gene in the engineered host cell. Additionally or alternatively, the engineered host cell may be modified to synthetically regulate the expression of the SepR gene in the engineered host cell. In examples, the engineered host cell may be modified to incorporate a copy, copies, or additional copies, of the SepR gene. Additionally or alternatively, the engineered host cell may be modified to incorporate the introduction of a strong promoter element for the overexpression of the SepR gene within the engineered host cell. In some cases, the SepR gene may be codon optimized for expression in *Saccharomyces cerevisiae*. The SepR gene may be derived from *Rattus norvegicus, Homo sapiens, Mus musculus*, or another species. In some examples, the SepR gene may be 72% similar to the naturally occurring gene.

[PCD] In some examples, the engineered host cell may modify the expression of the enzyme 4a-hydroxytetrahydrobiopterin (pterin-4a-carbinolamine) dehydratase. 4a-hydroxytetrahydrobiopterin dehydratase is encoded by the PCD gene. In some examples, 4a-hydroxytetrahydrobiopterin dehydratase catalyzes the reaction of 4a-hydroxytetrahydrobiopterin→H$_2$O+quinonoid dihydropteridine, as referenced in FIG. 1. The engineered host cell may be modified to include constitutive expression of the PCD gene in the engineered host cell. Additionally or alternatively, the engineered host cell may be modified to synthetically regulate the expression of the PCD gene in the engineered host cell. In examples, the engineered host cell may be modified to incorporate a copy, copies, or additional copies, of the PCD gene. Additionally or alternatively, the engineered host cell may be modified to incorporate the introduction of a strong promoter element for the overexpression of the PCD gene within the engineered host cell. In some cases, the PCD gene may be codon optimized for expression in *Saccharomyces cerevisiae*. The PCD gene may be derived from *Rattus norvegicus, Homo sapiens, Mus musculus*, or another species. In some examples, the PCD gene may be 79% similar to the naturally occurring gene.

[QDHPR] In some examples, the engineered host cell may modify the expression of the enzyme quinonoid dihydropteridine reductase. Quinonoid dihydropteridine reductase is encoded by the QDHPR gene. In some examples, quinonoid dihydropteridine reductase catalyzes the reaction of quinonoid dihydropteridine→BH$_4$, as referenced in FIG. 1. The engineered host cell may be modified to include constitutive expression of the QDHPR gene in the engineered host cell. Additionally or alternatively, the engineered host cell may be modified to synthetically regulate the expression of the QDHPR gene in the engineered host cell. In examples, the engineered host cell may be modified to incorporate a copy, copies, or additional copies, of the QDHPR gene. Additionally or alternatively, the engineered host cell may be modified to incorporate the introduction of a strong promoter element for the overexpression of the QDHPR gene within the engineered host cell. In some cases, the QDHPR gene may be codon optimized for expression in *Saccharomyces cerevisiae*. The QDHPR gene may be derived from *Rattus norvegicus, Homo sapiens, Mus musculus*, or another species. In some examples, the QDHPR gene may be 75% similar to the naturally occurring gene.

[DHFR] In some examples, the engineered host cell may modify the expression of the enzyme dihydrofolate reductase. Dihydrofolate reductase is encoded by the DHFR gene. In some examples, dihydrofolate reductase catalyzes the reaction of 7,8-dihydrobiopterin (BH$_2$)→5,6,7,8-tetrahydrobiopterin (BH$_4$), as referenced in FIG. 1. This reaction may be useful in recovering BH$_4$ as a co-substrate for the converstion oftyrosine to L-DOPA, as illustrated in FIG. 12. The engineered host cell may be modified to include constitutive expression of the DHFR gene in the engineered host cell. Additionally or alternatively, the engineered host cell may be modified to synthetically regulate the expression of the DHFR gene in the engineered host cell. In examples, the engineered host cell may be modified to incorporate a copy, copies, or additional copies, of the DHFR gene. Additionally or alternatively, the engineered host cell may be modified to incorporate the introduction of a strong promoter element for the overexpression of the DHFR gene within the engineered host cell. In some cases, the DHFR gene may be codon optimized for expression in *Saccharomyces cerevisiae*. The DHFR gene may be derived from *Rattus norvegicus, Homo sapiens*, or another species. In some examples, the DHFR gene may be 77% similar to the naturally occurring gene.

Figure 14:
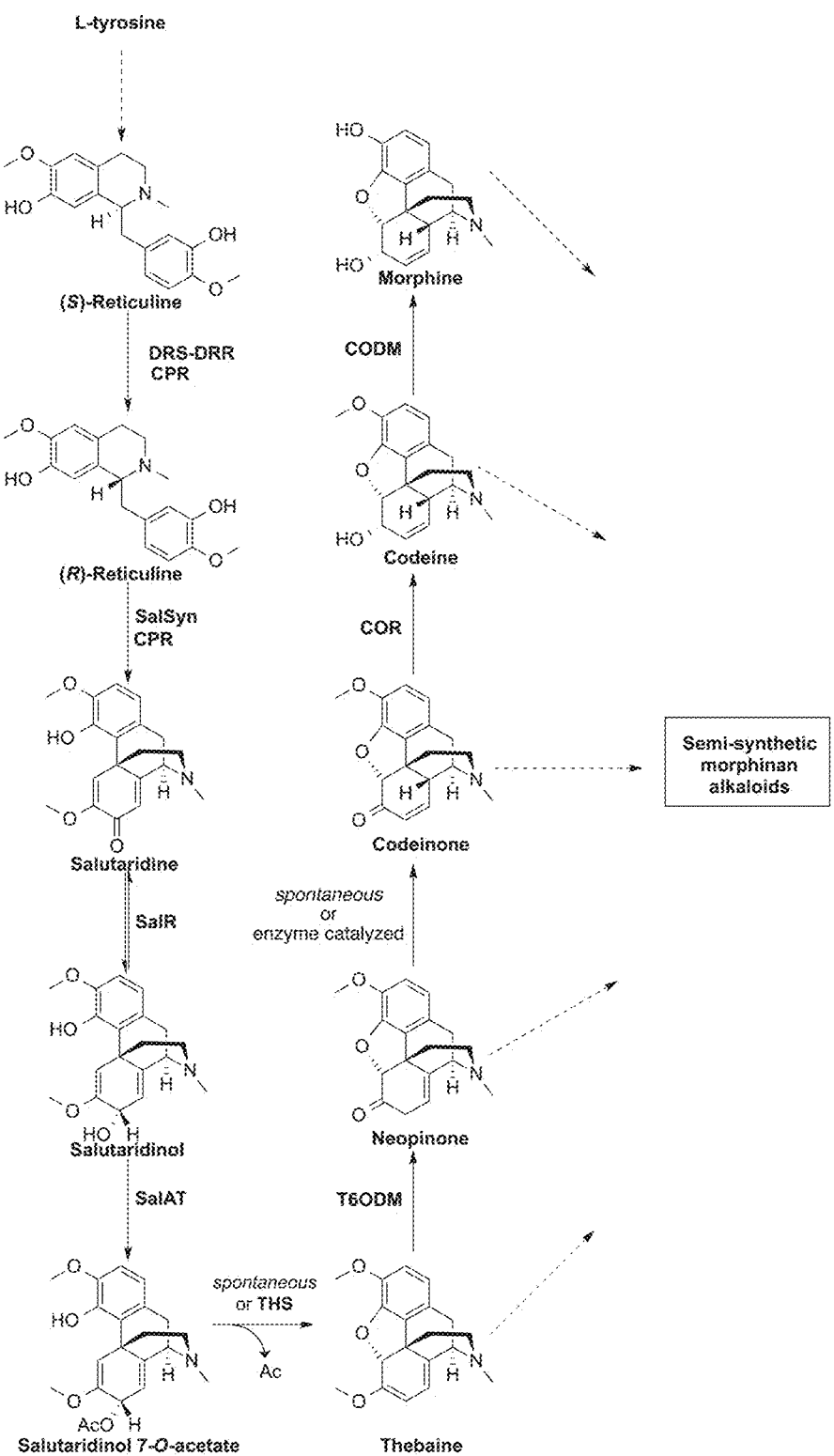
FIG. 14 illustrates a biosynthetic scheme for conversion of L-tyrosine to morphinan alkaloids, in accordance with embodiments of the invention.

[DRS-DRR] As discussed above with regard to epimerizing 1-BIAs, the engineered host cell may modify the expression of a BIA epimerase. The BIA epimerase is encoded by the DRS-DRR gene. In some examples, DRS-DRR may also be referred to as CYP-COR. In some examples, an engineered split version, or an engineered fused version, of a BIA epimerase catalyzes the conversion of (S)-1-BIA→(R)-1-BIA, as referenced in FIG. 14. In particular, FIG. 14 illustrates a biosynthetic scheme for conversion of L-tyrosine to morphinan alkaloids, in accordance with embodiments of the invention. FIG. 14 provides the use of the enzymes CPR, cytochrome P450 reductase; DRS-DRR, dehydroreticuline synthase and dehydroreticuline reductase; SalSyn, salutaridine synthase; SalR, salutaridine reductase; SalAT, salutaridinol 7-O-acetyltransferase; T6ODM, thebaine 6-O-demethylase; COR, codeinone reductase; and CODM, codeine-O-demethylase.

The engineered host cell may be modified to include constitutive expression of the engineered DRS-DRR gene in the engineered host cell. In some cases, the engineered DRS-DRR gene may encode an engineered fusion epimerase. In some cases, the engineered DRS-DRR gene may encode an engineered split epimerase. Additionally or alternatively, the engineered host cell may be modified to synthetically regulate the expression of the DRS-DRR gene in the engineered host cell. In examples, the engineered host cell may be modified to incorporate a copy, copies, or additional copies, of the DRS-DRR gene. Additionally or alternatively, the engineered host cell may be modified to incorporate the introduction of a strong promoter element for the overexpression of the DRS-DRR gene within the engineered host cell. The DRS-DRR gene may be derived from *Papaver bracteatum, Papaver somniferum, Papaver setigerum, Chelidonium majus*, or another species. In some examples, the DRS-DRR gene may be 77% similar to the naturally occurring gene.

[CPR] In some examples, the engineered host cell may modify the expression of the enzyme cytochrome P450 reductase. The cytochrome P450 reductase is encoded by the CPR gene. In some examples, the cytochrome P450 reductase catalyzes the reaction of (R)-reticuline→salutaridine, as referenced in FIG. 14. Additionally, the cytochrome P450 reductase catalyzes other reactions such as those described in FIGS. throughout the application. The engineered host cell may be modified to include constitutive expression of the CPR gene in the engineered host cell. Additionally or alternatively, the engineered host cell may be modified to synthetically regulate the expression of the CPR gene in the engineered host cell. In examples, the engineered host cell may be modified to incorporate a copy, copies, or additional copies, of the CPR gene. Additionally or alternatively, the engineered host cell may be modified to incorporate the introduction of a strong promoter element for the overexpression of the CPR gene within the engineered host cell. The CPR gene may be derived from *E. californica, P. somniferum, H. sapiens, S. cerevisiae, A. thaliana*, or another species. In some examples, the CPR gene may be 100% similar to the naturally occurring gene.

[SalSyn] In some examples, the engineered host cell may modify the expression of the enzyme salutaridine synthase. The salutaridine synthase is encoded by the SalSyn gene. In some examples, the salutaridine synthase catalyzes the reaction of (R)-reticuline→salutaridine, as referenced in FIG. 14. The engineered host cell may be modified to include constitutive expression of the SalSyn gene in the engineered host cell. Additionally or alternatively, the engineered host cell may be modified to synthetically regulate the expression of the SalSyn gene in the engineered host cell. In examples, the engineered host cell may be modified to incorporate a copy, copies, or additional copies, of the SalSyn gene. Additionally or alternatively, the engineered host cell may be modified to incorporate the introduction of a strong promoter element for the overexpression of the SalSyn gene within the engineered host cell. In some cases, the SalSyn gene may be codon optimized for expression in *Saccharomyces cerevisiae*. In some examples the SalSyn may be modified at the N-terminus. The SalSyn gene may be derived from *Papaver somniferum, Papaver* spp, *Chelidonium majus*, or another species. In some examples, the SalSyn gene may be 78% similar to the naturally occurring gene.

[SalR] In some examples, the engineered host cell may modify the expression of the enzyme salutaridine reductase. Salutaridine reductase is encoded by the SalR gene. In some examples, salutaridine reductase reversibly catalyzes the reaction of salutaridinol→salutaridine, as referenced in FIG. 14. The engineered host cell may be modified to include constitutive expression of the SalR gene in the engineered host cell. Additionally or alternatively, the engineered host cell may be modified to synthetically regulate the expression of the SalR gene in the engineered host cell. In examples, the engineered host cell may be modified to incorporate a copy, copies, or additional copies, of the SalR gene. Additionally or alternatively, the engineered host cell may be modified to incorporate the introduction of a strong promoter element for the overexpression of the SalR gene within the engineered host cell. In some cases, the SalR gene may be codon optimized for expression in *Saccharomyces cerevisiae*. The SalR gene may be derived from *Papaver somniferum, Papaver bracteatum, Papaver* spp., *Chelidonium majus*, or another species. In some examples, the SalR gene may be 80-100% similar to the naturally occurring gene.

[SalAT] In some examples, the engineered host cell may modify the expression of the enzyme acetyl-CoA: salutaridinol 7-O-acetyltransferase. Acetyl-CoA: salutaridinol 7-O-acetyltransferase is encoded by the SalAT gene. In some examples, acetyl-CoA:salutaridinol 7-O-acetyltransferase catalyzes the reaction of acetyl-CoA+salutaridinol→CoA+7-O-acetylsalutaridinol, as referenced in FIG. 14. The engineered host cell may be modified to include constitutive expression of the SalAT gene in the engineered host cell. Additionally or alternatively, the engineered host cell may be modified to synthetically regulate the expression of the SalAT gene in the engineered host cell. In examples, the engineered host cell may be modified to incorporate a copy, copies, or additional copies, of the SalAT gene. Additionally or alternatively, the engineered host cell may be modified to incorporate the introduction of a strong promoter element for the overexpression of the SalAT gene within the engineered host cell. In some cases, the SalAT gene may be codon optimized for expression in *Saccharomyces cerevisiae*. The SalAT gene may be derived from *Papaver somniferum, Papaver bracteatum, Papaver orientale, Papaver* spp., or another species. In some examples, the SalAT gene may be 77-80% similar to the naturally occurring gene.

[TS] In some examples, the engineered host cell may modify the expression of the enzyme thebaine synthase. Thebaine synthase is encoded by the TS gene. In some examples, a thebaine synthase or an engineered thebaine synthase catalyzes the reaction of 7-O-acetylsalutaridinol→thebaine+acetate, as referenced in FIG. 14. In some examples, the reaction of 7-O-acetylsalutaridinol→thebaine+acetate occurs spontaneously, but thebaine synthase catalyzes some portion of this reaction. In particular, FIG. 14 illustrates a biosynthetic scheme for conversion of L-tyrosine to morphinan alkaloids, in accordance with embodiments of the invention. FIG. 14 provides the use of the enzymes CPR, cytochrome P450 reductase; DRS-DRR, dehydroreticuline synthase and dehydroreticuline reductase; SalSyn, salutaridine synthase; SalR, salutaridine reductase;

SalAT, salutaridinol 7-O-acetyltransferase; TS, thebaine synthase; T6ODM, thebaine 6-O-demethylase; COR, codeinone reductase; and CODM, codeine-O-demethylase.

The engineered host cell may be modified to include constitutive expression of the TS gene or the engineering TS gene in the engineered host cell. In some cases, the engineered TS gene may encode an engineered fusion enzyme. Additionally or alternatively, the engineered host cell may be modified to synthetically regulate the expression of the TS gene in the engineered host cell. In examples, the engineered host cell may be modified to incorporate a copy, copies, or additional copies, of the TS gene. Additionally or alternatively, the engineered host cell may be modified to incorporate the introduction of a strong promoter element for the overexpression of the TS gene within the engineered host cell. In some cases, the TS gene may be codon optimized for expression in *Saccharomyces cerevisiae*. The TS gene may be derived from *Papaver somniferum, Papaver bracteatum, Papaver orientale, Papaver* spp., or another species. In some examples, the TS gene may be 75-80% similar to the naturally occurring gene.

[T6ODM] In some examples, the engineered host cell may modify the expression of the enzyme thebaine 6-O-demethylase. Thebaine 6-O demethylase is encoded by the T6ODM gene. In some examples, thebaine 6-O-demethylase catalyzes the reaction of thebaine→neopinone, as referenced in FIG. 14. Once the neopinone has been produced, the neopinone may be converted to codeinone. The conversion of neopinone→codeinone may occur spontaneously. Alternatively, the conversion of neopinone→codeinone may occur as a result of a catalyzed reaction. In other examples, the T6ODM enzyme may catalyze the O-demethylation of substrates other than thebaine. For example, T6ODM may O-demethylate oripavine to produce morphinone. Alternatively, T6ODM may catalyze the O-demethylation of BIAs within the 1-benzylisoquinoline, protoberberine, or protopine classes such as papaverine, canadine, and allocryptopine, respectively. The engineered host cell may be modified to include constitutive expression of the T6ODM gene in the engineered host cell. Additionally or alternatively, the engineered host cell may be modified to synthetically regulate the expression of the T6ODM gene in the engineered host cell. In examples, the engineered host cell may be modified to incorporate a copy, copies, or additional copies, of the T6ODM gene. Additionally or alternatively, the engineered host cell may be modified to incorporate the introduction of a strong promoter element for the overexpression of the T6ODM gene within the engineered host cell. In some cases, the T6ODM gene may be codon optimized for expression in *Saccharomyces cerevisiae*. The T6ODM gene may be derived from *Papaver somniferum*, or another species. In some examples, the T6ODM gene may be 76.2% similar to the naturally occurring gene.

[COR] In some examples, the engineered host cell may modify the expression of the enzyme codeinone reductase. Codeinone reductase is encoded by the COR gene. In some examples, codeinone reductase catalyzes the reaction of codeinone to codeine, as referenced in FIG. 14. In some cases, codeinone reductase can catalyze the reaction of neopinone to neopine. In other examples, COR can catalyze the reduction of other morphinans including hydrocodone-→dihydrocodeine, 14-hydroxycodeinone→14-hydroxycodeine, and hydromorphone→dihydromorphine. The engineered host cell may be modified to include constitutive expression of the COR gene in the engineered host cell. Additionally or alternatively, the engineered host cell may be modified to synthetically regulate the expression of the COR gene in the engineered host cell. In examples, the engineered host cell may be modified to incorporate a copy, copies, or additional copies, of the COR gene. Additionally or alternatively, the engineered host cell may be modified to incorporate the introduction of a strong promoter element for the overexpression of the COR gene within the engineered host cell. In some cases, the COR gene may be codon optimized for expression in *Saccharomyces cerevisiae*. Additionally or alternatively, the COR gene may be modified with the addition of targeting sequences for mitochondria, vacuole, endoplasmic reticulum, or a combination thereof. The COR gene may be derived from *Papaver somniferum*, or another species. In some examples, the COR gene may be 76-78% similar to the naturally occurring gene. In examples, the COR gene may be 76.8%, 77.0%, 77.3%, or 77.7% similar to the naturally occurring gene.

[CODM] In some examples, the engineered host cell may modify the expression of the enzyme codeine O-demethylase. Codeine O-demethylase is encoded by the CODM gene. In some examples, codeine O-demethylase catalyzes the reaction of codeine to morphine, as referenced in FIG. 14. Codeine O-demethylase can also catalyze the reaction of neopine to neomorphine. Codeine O-demethylase can also catalyze the reaction of thebaine to oripavine. In other examples, CODM may catalyze the O-demethylation of BIAs within the 1-benzylisoquinoline, aporphine, and protoberberine classes such as reticuline, isocorydine, and scoulerine, respectively. In other examples, the CODM enzyme may catalyze an O,O-demethylenation reaction to cleave the methylenedioxy bridge structures in protopines. The engineered host cell may be modified to include constitutive expression of the CODM gene in the engineered host cell. Additionally or alternatively, the engineered host cell may be modified to synthetically regulate the expression of the CODM gene in the engineered host cell. In examples, the engineered host cell may be modified to incorporate a copy, copies, or additional copies, of the CODM gene. Additionally or alternatively, the engineered host cell may be modified to incorporate the introduction of a strong promoter element for the overexpression of the CODM gene within the engineered host cell. In some cases, the CODM gene may be codon optimized for expression in *Saccharomyces cerevisiae*. Additionally or alternatively, the CODM gene may be modified with the addition of targeting sequences for mitochondria. The CODM gene may be derived from *Papaver somniferum, Papaver* spp., or another species. In some examples, the CODM gene may be 75% similar to the naturally occurring gene. In examples, the CODM gene may be 75.2% similar to the naturally occurring gene.

[BBE] In some examples, the engineered host cell may modify the expression of the enzyme berberine bridge enzyme. The berberine bridge enzyme is encoded by the BBE gene. In some examples, berberine bridge enzyme catalyzes the reaction of (S)-reticuline→(S)-scoulerine. The engineered host cell may be modified to include constitutive expression of the BBE gene in the engineered host cell. Additionally or alternatively, the engineered host cell may be modified to synthetically regulate the expression of the BBE gene in the engineered host cell. In examples, the engineered host cell may be modified to incorporate a copy, copies, or additional copies, of the BBE gene. Additionally or alternatively, the engineered host cell may be modified to incorporate the introduction of a strong promoter element for the overexpression of the BBE gene within the engineered host cell. The BBE gene may be derived from *Papaver somniferum, Argemone mexicana, Eschscholzia*

*californica, Berberis stolonifera, Thalictrum flavum* subsp. *glaucum, Coptis japonica, Papaver* spp., or another species. In some examples, the BBE gene may be 99% similar to the naturally occurring gene.

[CYP2D6] In some examples, the engineered host cell may modify the expression of cytochrome P450, family 2, subfamily D, polypeptide 6. This particular cytochrome P450 is encoded by the CYP2D6 gene. This particular cytochrome P450 enzyme may be characterized as a promiscuous oxidase. In some examples, this particular cytochrome P450 enzyme may catalyze the reaction of (R)-reticuline+NADPH+H$^+$+O$_2$→salutaridine+NADP$^+$+2 H$_2$O, among other reactions.

[S9OMT] In some examples, the engineered host cell may modify the expression of the enzyme S-adenosyl-L-methionine: (S)-scoulerine 9-O-methyltransferase. S-adenosyl-L-methionine: (S)-scoulerine 9-O-methyltransferase is encoded by the S9OMT gene. In some examples, S-adenosyl-L-methionine: (S)-scoulerine 9-O-methyltransferase catalyzes the reaction of S-adenosyl-L-methionine+(S)-scoulerine→S-adenosyl-L-homocysteine+(S)-tetrahydrocolumbamine. The engineered host cell may be modified to include constitutive expression of the S9OMT gene in the engineered host cell. Additionally or alternatively, the engineered host cell may be modified to synthetically regulate the expression of the S9OMT gene in the engineered host cell. In examples, the engineered host cell may be modified to incorporate a copy, copies, or additional copies, of the S9OMT gene. Additionally or alternatively, the engineered host cell may be modified to incorporate the introduction of a strong promoter element for the overexpression of the S9OMT gene within the engineered host cell. In some cases, the S9OMT gene may be codon optimized for expression in *Saccharomyces cerevisiae*. The S9OMT gene may be derived from *Thalictrum flavum* subsp. *glaucum, Coptis japonica, Coptis chinensis, Papaver somniferum, Thalictrum* spp., *Coptis* spp., *Papaver* spp., or another species. In some examples, the S9OMT gene may be 100% similar to the naturally occurring gene. In examples, the S9OMT gene may be 80% similar to the naturally occurring gene.

[CAS] In some examples, the engineered host cell may modify the expression of the enzyme (S)-canadine synthase. (S)-canadine synthase is encoded by the CAS gene. In some examples, (S)-canadine synthase catalyzes the reaction of (S)-tetrahydrocolumbamine→(S)-canadine. The engineered host cell may be modified to express the CAS gene in the engineered host cell. The engineered host cell may be modified to include constitutive expression of the CAS gene in the engineered host cell. Additionally or alternatively, the engineered host cell may be modified to synthetically regulate the expression of the CAS gene in the engineered host cell. In examples, the engineered host cell may be modified to incorporate a copy, copies, or additional copies, of the CAS gene. Additionally or alternatively, the engineered host cell may be modified to incorporate the introduction of a strong promoter element for the overexpression of the CAS gene within the engineered host cell. The CAS gene may be derived from *Thalictrum flavum* subsp. *glaucum, Coptis japonica, Thalictrum* spp., *Coptis* spp., or another species. In some examples, the CAS gene may be 100% similar to the naturally occurring gene.

[STOX] In some examples, the engineered host cell may modify the expression of the enzyme (S)-tetrahydroprotoberberine oxidase. (S)-tetrahydroprotoberberine oxidase is encoded by the STOX gene. In some examples, (S)-tetrahydroprotoberberine oxidase catalyzes the reaction of (S)-tetrahydroberberine+2 O$_2$→berberine+2H$_2$O$_2$. The engineered host cell may be modified to include constitutive expression of the STOX gene in the engineered host cell. Additionally or alternatively, the engineered host cell may be modified to synthetically regulate the expression of the STOX gene in the engineered host cell. In examples, the engineered host cell may be modified to incorporate a copy, copies, or additional copies, of the STOX gene. Additionally or alternatively, the engineered host cell may be modified to incorporate the introduction of a strong promoter element for the overexpression of the STOX gene within the engineered host cell. In some examples the STOX may be modified at the N-terminus. In some cases, the STOX gene may be codon optimized for expression in *Saccharomyces cerevisiae*. The STOX gene may be derived from *Berberis wilsonae, Coptis japonica, Berberis* spp., *Coptis* spp., or another species. In some examples, the STOX gene may be 78% similar to the naturally occurring gene.

[TNMT] In some examples, the engineered host cell may modify the expression of the enzyme tetrahydroprotoberberine-N-methyltransferase. Tetrahydroprotoberberine-N-methyltransferase is encoded by the TNMT gene. In some examples, tetrahydroprotoberberine-N-methyltransferase catalyzes the reaction of canadine→N-methylcanadine.

In other examples, tetrahydroprotoberberine-N-methyltransferase catalyzes the reaction of stylopine→cis-N-methylstylopine. The engineered host cell may be modified to include constitutive expression of the TNMT gene in the engineered host cell. Additionally or alternatively, the engineered host cell may be modified to synthetically regulate the expression of the TNMT gene in the engineered host cell. In examples, the engineered host cell may be modified to incorporate a copy, copies, or additional copies, of the TNMT gene. Additionally or alternatively, the engineered host cell may be modified to incorporate the introduction of a strong promoter element for the overexpression of the TNMT gene within the engineered host cell. In some cases, the TNMT gene may be codon optimized for expression in *Saccharomyces cerevisiae*. The TNMT gene may be derived from *Papaver somniferum, Eschscholzia californica, Papaver bracteatum, Argemone mexicana*, or another species. In some examples, the TNMT gene may be 100% similar to the naturally occurring gene. In examples, the TNMT gene may be 81% similar to the naturally occurring gene.

[CFS] In some examples, the engineered host cell may modify the expression of the enzyme cheilanthifoline synthase. Cheilanthifoline synthase is encoded by the CFS gene. In examples, cheilanthifoline synthase catalyzes the reaction of scoulerine→cheilanthifoline. An engineered host cell may be modified to include constitutive expression of the CFS gene in the engineered host cell. Additionally or alternatively, the engineered host cell may be modified to synthetically regulate the expression of the CFS gene in the engineered host cell. In examples, the engineered host cell may be modified to incorporate a copy, copies, or additional copies, of the CFS gene. Additionally or alternatively, the engineered host cell may be modified to incorporate the introduction of a strong promotor element for the overexpression of the CFS gene within the engineered host cell. The CFS gene may be derived from *P. somniferum, E. californica, A. mexicana*, or another species. In some examples, the CFS gene may be 77%, 78%, or 79% similar to the naturally occurring gene. Additionally, the CFS gene may be codon optimized for expression in *Saccharomyces cerevisiae*.

In some examples, the engineered host cell may modify the expression of the enzyme stylopine synthase. Stylopine synthase is encoded by the STS gene. In examples, stylopine synthase catalyzes the reaction of cheilanthifoline→stylopine. An engineered host cell may be modified to include constitutive expression of the STS gene in the engineered host cell. Additionally or alternatively, the engineered host cell may be modified to synthetically regulate the expression of the STS gene in the engineered host cell. In examples, the engineered host cell may be modified to incorporate a copy, copies, or additional copies, of the STS gene. Additionally or alternatively, the engineered host cell may be modified to incorporate the introduction of a strong promotor element for the overexpression of the STS gene within the engineered host cell. The STS gene may be derived from *P. somniferum, E. californica, A. mexicana*, or another species. In some examples, the STS gene may be 76%, 78%, or 79% similar to the naturally occurring gene. Additionally, the STS gene may be codon optimized for expression in *Saccharomyces cerevisiae*.

[STS] In some examples, the engineered host cell may modify the expression of the enzyme stylopine synthase. Stylopine synthase is encoded by the STS gene. In examples, stylopine synthase catalyzes the reaction of cheilanthifoline→stylopine, among other reactions. An engineered host cell may be modified to include constitutive expression of the STS gene in the engineered host cell. Additionally or alternatively, the engineered host cell may be modified to synthetically regulate the expression of the STS gene in the engineered host cell. In examples, the engineered host cell may be modified to incorporate a copy, copies, or additional copies, of the STS gene. Additionally or alternatively, the engineered host cell may be modified to incorporate the introduction of a strong promotor element for the overexpression of the STS gene within the engineered host cell. The STS gene may be derived from *P. somniferum, E. californica, A. mexicana*, or another species. In some examples, the STS gene may be 76%, 78%, or 79% similar to the naturally occurring gene. Additionally, the STS gene may be codon optimized for expression in *Saccharomyces cerevisiae*.

[MSH] In some examples, the engineered host cell may modify the expression of the enzyme cis-N-methylstylopine 14-hydroxylase. Cis-N-methylstylopine 14-hydroxylase is encoded by the MSH gene. In examples, cis-N-methylstylopine 14-hydroxylase catalyzes the reaction of cis-N-methylstylopine→protopine. An engineered host cell may be modified to include constitutive expression of the MSH gene in the engineered host cell. Additionally or alternatively, the engineered host cell may be modified to synthetically regulate the expression of the MSH gene in the engineered host cell. In examples, the engineered host cell may be modified to incorporate a copy, copies, or additional copies, of the MSH gene. Additionally or alternatively, the engineered host cell may be modified to incorporate the introduction of a strong promotor element for the overexpression of the MSH gene within the engineered host cell. The MSH gene may be derived from *P. somniferum* or another species. In some examples, the MSH gene may be 79% similar to the naturally occurring gene. Additionally, the MSH gene may be codon optimized for expression in *Saccharomyces cerevisiae*.

[P6H] In some examples, the engineered host cell may modify the expression of the enzyme protopine-6-hydroxylase. Protopine-6-hydroxylase is encoded by the P6H gene. In examples, protopine-6-hydroxylase catalyzes the reaction of Protopine→6-hydroxyprotopine. An engineered host cell may be modified to include constitutive expression of the P6H gene in the engineered host cell. Additionally or alternatively, the engineered host cell may be modified to synthetically regulate the expression of the P6H gene in the engineered host cell. In examples, the engineered host cell may be modified to incorporate a copy, copies, or additional copies, of the P6H gene. Additionally or alternatively, the engineered host cell may be modified to incorporate the introduction of a strong promotor element for the overexpression of the CFS gene within the engineered host cell. The P6H gene may be derived from *P. somniferum, E. californica*, or another species. In some examples, the P6H gene may be 79% similar to the naturally occurring gene. Additionally, the P6H gene may be codon optimized for expression in *Saccharomyces cerevisiae*.

[DBOX] In some examples, the engineered host cell may modify the expression of the enzyme dihydrobenzophenanthridine oxidase. Dihydrobenzophenanthridine oxidase is encoded by the DBOX gene. In examples, dihydrobenzophenanthridine oxidase catalyzes the reaction of dihydrosanguinarine→sanguinarine. An engineered host cell may be modified to include constitutive expression of the DBOX gene in the engineered host cell. Additionally or alternatively, the engineered host cell may be modified to synthetically regulate the expression of the DBOX gene in the engineered host cell. In examples, the engineered host cell may be modified to incorporate a copy, copies, or additional copies, of the DBOX gene. Additionally or alternatively, the engineered host cell may be modified to incorporate the introduction of a strong promotor element for the overexpression of the DBOX gene within the engineered host cell. The DBOX gene may be derived from *P. somniferum* or another species. In some examples, the DBOX gene may be 100% similar to the naturally occurring gene. Additionally, the DBOX gene may be codon optimized for expression in *Saccharomyces cerevisiae*.

Figure 15:
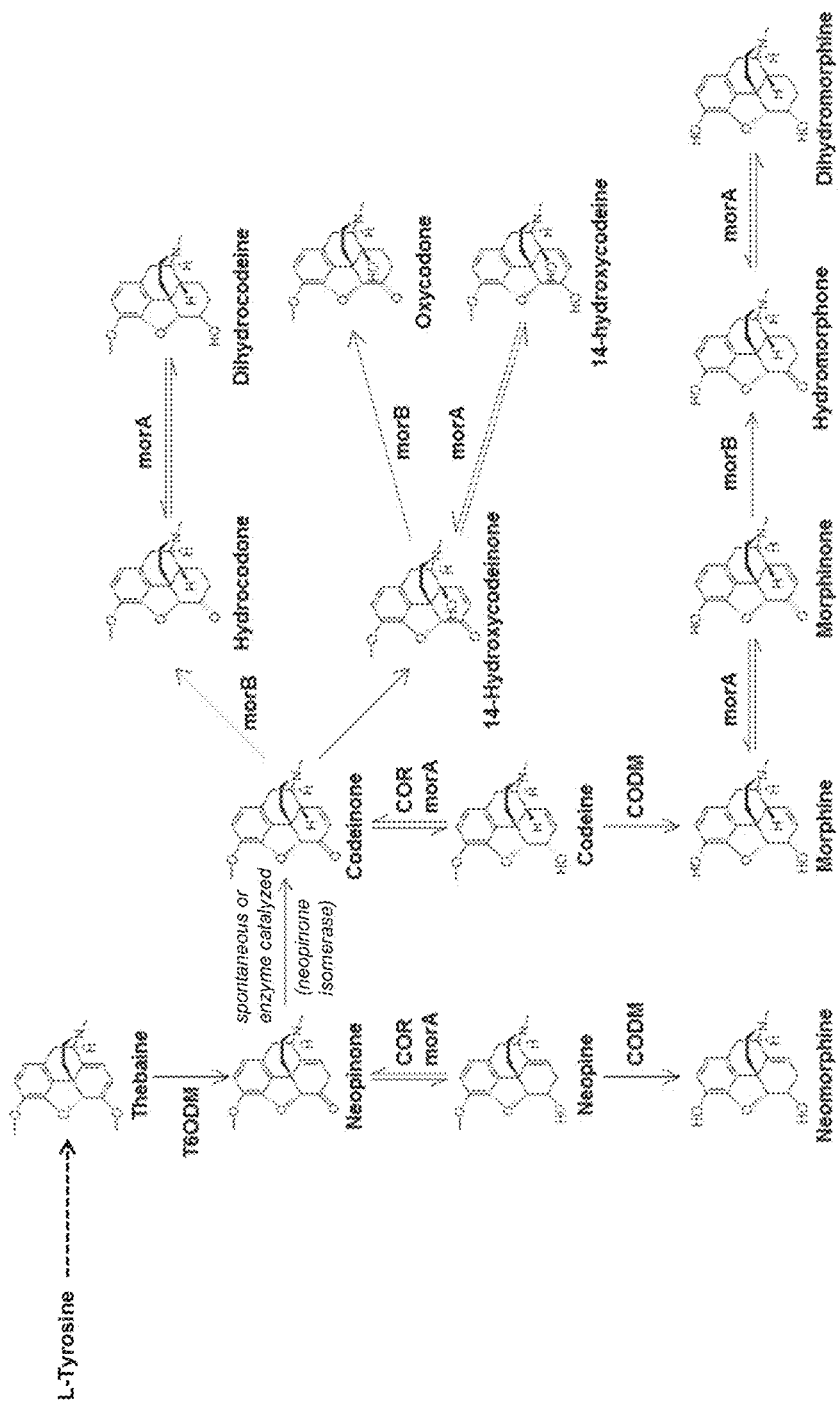
FIG. 15 illustrates a biosynthetic scheme for production of semi-synthetic opioids, in accordance with embodiments of the invention.
Figure 16:
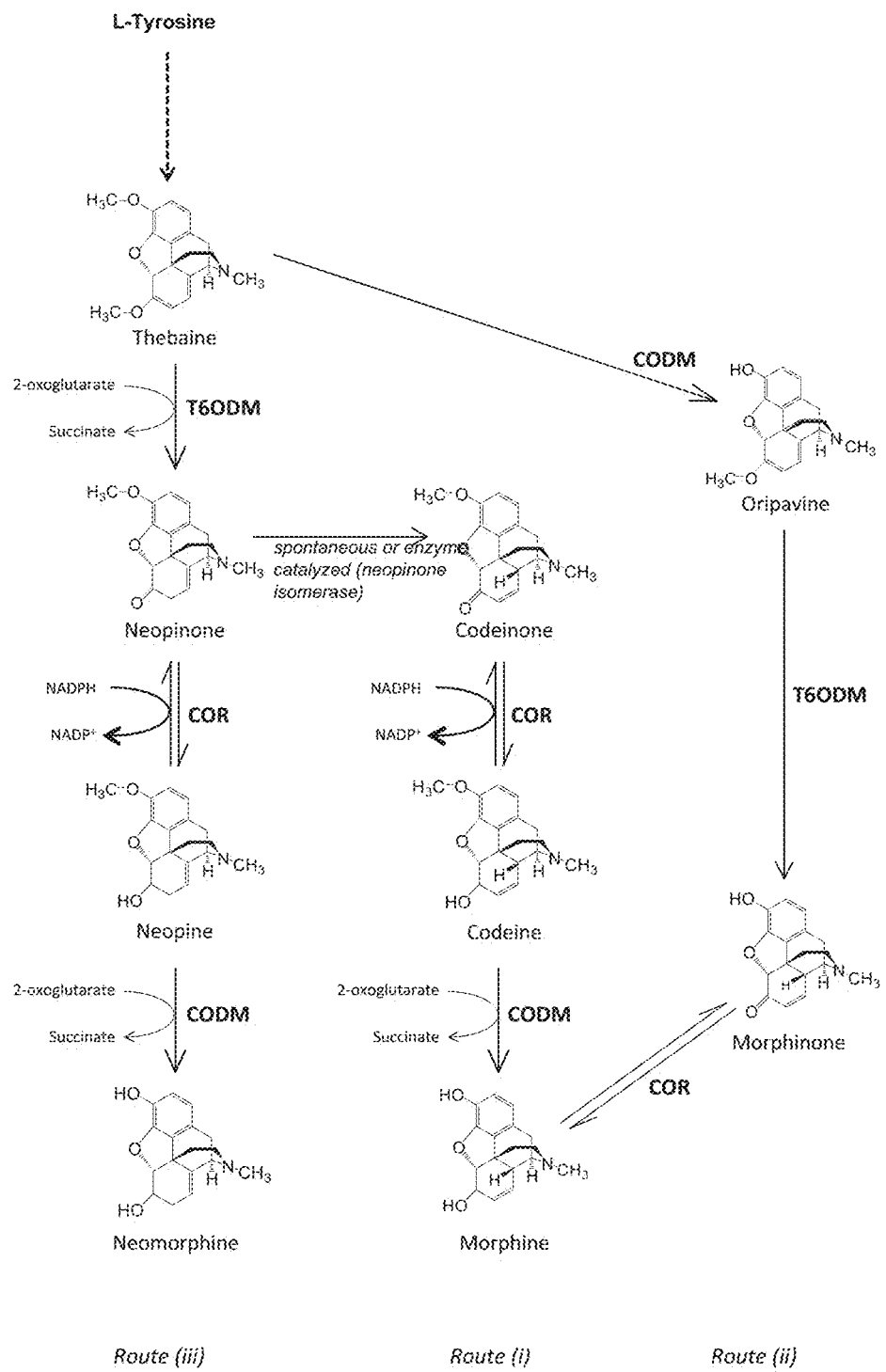
FIG. 16 illustrates a biosynthetic scheme for production of opioids, in accordance with embodiments of the invention.

[morA] In some examples, the engineered host cell may modify the expression of the enzyme morphine dehydrogenase. Morphine dehydrogenase is encoded by the morA gene. In some examples, morphine dehydrogenase catalyzes the reaction of morphine→morphinone, as referenced in FIG. 15. In other examples, morphine dehydrogenase catalyzes the reaction of codeinone→codeine, also as referenced in FIG. 15. FIG. 15 illustrates a biosynthetic scheme for production of semi-synthetic opiods, in accordance with embodiments of the invention. In particular, FIG. 15 illustrates extended transformations of thebaine in yeast by incorporating morA, morphine dehydrogenase; and morB, morphine reductase.

The engineered host cell may be modified to include constitutive expression of the morA gene in the engineered host cell. Additionally or alternatively, the engineered host cell may be modified to synthetically regulate the expression of the morA gene in the engineered host cell. In examples, the engineered host cell may be modified to incorporate a copy, copies, or additional copies, of the morA gene. Additionally or alternatively, the engineered host cell may be modified to incorporate the introduction of a strong promoter element for the overexpression of the morA gene within the engineered host cell. In some cases, the morA gene may be codon optimized for expression in *Saccharomyces cerevisiae*. The morA gene may be derived from *Pseudomonas putida* or another species. In some examples, the morA gene may be 73.7% similar to the naturally occurring gene.

[morB] In some examples, the engineered host cell may modify the expression of the enzyme morphinone reductase. Morphinone reductase is encoded by the morB gene. In some examples, morphinone reductase catalyzes the reaction of codeinone→hydrocodone, as referenced in FIG. 15. In other examples, morphinone reductase catalyzes the reaction of morphinone→hydromorphone, also as referenced in FIG. 15. In other examples, morphinone reductase catalyzes the reaction 14-hydroxycodeinone→oxycodone. The engineered host cell may be modified to include constitutive expression of the morB gene in the engineered host cell. Additionally or alternatively, the engineered host cell may be modified to synthetically regulate the expression of the morB gene in the engineered host cell. In examples, the engineered host cell may be modified to incorporate a copy, copies, or additional copies, of the morB gene. Additionally or alternatively, the engineered host cell may be modified to incorporate the introduction of a strong promoter element for the overexpression of the morB gene within the engineered host cell. In some cases, the morB gene may be codon optimized for expression in *Saccharomyces cerevisiae*. The morB gene may be derived from *Pseudomonas putida* or another species. In some examples, the morB gene may be 67.2% similar to the naturally occurring gene.

Figure 17:
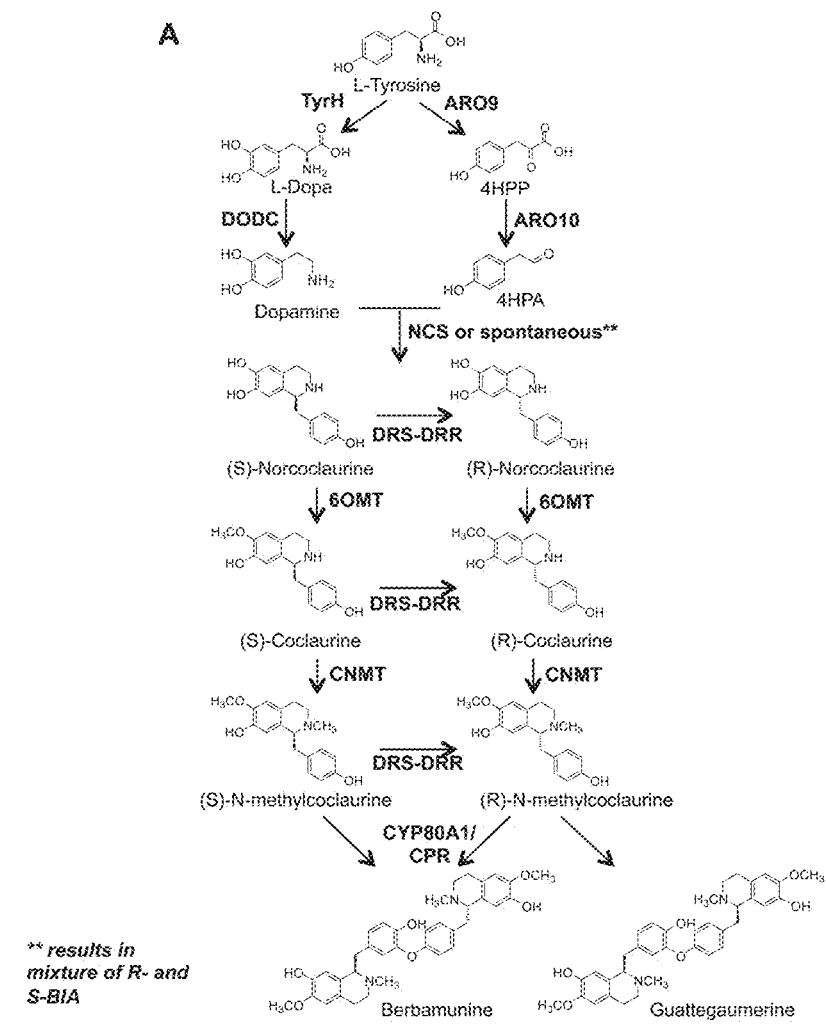
FIG. 17 illustrates (A) a biosynthetic scheme for conversion of L-tyrosine to bisBIAs and (B) yeast strains engineered to biosynthesize bisBIAs, in accordance with embodiments of the invention.

[CYP80A1] In some examples, the engineered host cell may express the enzyme berbamunine synthase. Berbamunine synthase is encoded by the gene for cytochrome P450 enzyme 80A1 (CYP80A1). In some examples, CYP80A1 catalyzes the reaction (S)—N-methylcoclaurine+(R)—N-methylcoclaurine→berbamunine, as referenced in FIG. 17. In other examples, CYP80A1 catalyzes the reaction (R)—N-methylcoclaurine+(R)—N-methylcoclaurine→guattegaumerine, as referenced in FIG. 17. In other examples, CYP80A1 catalyzes the reaction (R)—N-methylcoclaurine+(S)-coclaurine→2'norberbamunine. The engineered host cell may be modified to include constitutive expression of the CYP80A1 gene in the engineered host cell. Additionally or alternatively, the engineered host cell may be modified to synthetically regulate the expression of the CYP80A1 gene in the engineered host cell. In examples, the engineered host cell may be modified to incorporate a copy, copies, or additional copies, of the CYP80A1 gene. Additionally or alternatively, the engineered host cell may be modified to incorporate the introduction of a strong promoter element for the overexpression of the CYP80A1 gene within the engineered host cell. In some cases, the CYP80A1 gene may be codon optimized for expression in *Saccharomyces cerevisiae*. The CYP80A1 gene may be derived from *Berberis stolonifera* or another species. In some examples, the CYP80A1 gene may be 76% similar to the naturally occurring gene.

[PODA] In some example, the engineered host cell may express the enzyme protopine O-dealkylase. Protopine O-dealkylase is encoded by the gene PODA. In some examples, PODA catalyzes the O,O-demethylation of protoberberines and protopines such as canadine, stylopine, berberine, cryptopine, allocryptopine, and protopine. In some examples, PODA catalyzes the O-demethylation of BIAs including tetrahydropapaverine, tetrahydropalmatine, and cryptopine. The engineered host cell may be modified to include constitutive expression of the PODA gene in the engineered host cell. Additionally or alternatively, the engineered host cell may be modified to synthetically regulate the expression of the PODA gene in the engineered host cell. In examples, the engineered host cell may be modified to incorporate a copy, copies, or additional copies, of the PODA gene. Additionally or alternatively, the engineered host cell may be modified to incorporate the introduction of a strong promoter element for the overexpression of the PODA gene within the engineered host cell. In some cases, the PODA gene may be codon optimized for expression in *Saccharomyces cerevisiae*. The PODA gene may be derived from *Papaver somniferum* or other species. In some examples, the PODA gene may be 70-100% similar to the naturally occurring gene.

[RNMT] In some examples, the engineered host cell may modify the expression of the enzyme Reticuline N-methyltransferase. Reticuline N-methyltransferase is encoded by the RNMT gene. In some examples, Reticuline N-methyltransferase may catalyze reactions such as reticuline→tembetarine, among other reactions.

[P7OMT] In some examples, the engineered host cell may modify the expression of the enzyme Papaverine 7-O-demethylase. Papaverine 7-O-demethylase is encoded by the P7OMT gene. In some examples, Papaverine 7-O-demethylase may catalyze reactions such as papaverine-pacodine, among other reactions.

[3ODM] In some examples, the engineered host cell may modify the expression of the enzyme 3-O-demethylase. 3-O-demethylase is encoded by the 3ODM gene. In some examples, 3-O-demethylase may catalyze reactions such as oxycodone→oxymorphone; hydrocodone→hydromorphone; dihydrocodeine→dihydromorphine; 14-hydroxycodeine→14-hydroxymorphine; codeinone→morphinone; and 14-hydroxycodeinone→14-hydroxymorphinone, among other reactions.

[NDM] In some examples, the engineered host cell may modify the expression of the enzyme N-demethylase. N-demethylase is encoded by the NDM gene. In some examples, N-demethylase may catalyze reactions, such as Codeine→Norcodeine; Morphine→Normorphine; Oxycodone→Noroxycodone; Oxymorphone→Noroxymorphone; Thebaine→Northebaine; Oripavine→Nororipavine; Hydrocodone→Norhydrocodone; Hydromorphone→Norhydromorphone; Dihydrocodeine→Nordihydrocodeine; Dihydromorphine→Nordihydromorphine; 14-hydroxycodeine→Nor-14-hydroxycodeine; 14-hydroxymorphine→Nor-14-hydroxymorphine; Codeinone→Norcodeinone; Morphinone→Normorphinone; 14-hydroxycodeinone→Nor-14-hydroxycodeinone; and 14-hydroxymorphinone→Nor-14-hydroxymorphinone, among other reactions.

[NMT] In some examples, the engineered host cell may modify the expression of the enzyme N-methyltransferase. N-methyltransferase is encoded by the NMT gene. In some examples, N-methyltransferase may catalyze reactions, such as Norcodeine→codeine; Normorphine→morphine; Noroxycodone→oxycodone; Noroxymorphone→noroxymorphone; Northebaine→thebaine; Nororipavine→oripavine; Norhydrocodone→hydrocodone; Norhydromorphone→Hydromorphone; Nordihydrocodeine→Dihydrocodeine; Nordihydromorphine→Dihydromorphine; Nor-14-hydroxycodeine→14-hydroxycodeine; Nor-14-hydroxymorphine→14-hydroxymorphine; Norcodeineone→Codeineone; Normorphinone→Morphinone; Nor-14-hydroxy-codeinone→14-hydroxycodeinone; Nor-14→hydroxy-morphinone→14-hydroxymorphinone.

[NAT] In some examples, the engineered host cell may modify the expression of the enzyme N-allyltransferase. N-allyltransferase is encoded by the NAT gene. In some examples, N-allyltransferase may catalyze reactions, such as Norcodeine→N-allyl-norcodeine; Normorphine→N-allyl-normorphine; Noroxycodone→N-allyl-noroxycodone; Noroxymorphone→N-allyl-nornoroxymorphone; Northebaine→N-allyl-northebaine; Nororipavine→N-allyl-nororipavine; Norhydrocodone→N-allyl-norhydrocodone; Norhydromorphone→N-allyl-norhydromorphone; Nordihydrocodeine→N-allyl-nordihydrocodeine; Nordihydromorphine→N-allyl-nordihydromorphine; Nor-14-hydroxycodeine→N-allyl-nor-14-hydroxycodeine; Nor-14-hydroxymorphine→N-allyl-nor-14-hydroxymorphine; Norcodeineone→N-allyl-norcodeineone; Normorphinone→N-allyl-normorphinone; Nor-14-hydroxy-codeinone→N-allyl-nor-14-hydroxycodeinone; Nor-14-hydroxymorphinone→N-allyl-nor-14-hydroxymorphinone, among other reactions.

[CPMT] In some examples, the engineered host cell may modify the expression of the enzyme N-cyclopropylmethyltranserase. N-cyclopropylmethyltranserase is encoded by the CPMT gene. In some examples, N-cyclopropylmethyltransferase may catalyze reactions, such as Norcodeine→N(cyclopropylmethyl)norcodeine; Normorphine→N(cyclopropylmethyl) normorphine; Noroxycodone→N(cyclopropylmethyl) noroxycodone; Noroxymorphone→N(cyclopropylmethyl) noroxymorphone; Northebaine→N(cyclopropylmethyl) northebaine; Nororipavine→N(cyclopropylmethyl) nororipavine; Norhydrocodone→N(cyclopropylmethyl) norhydrocodone; Norhydromorphone→N(cyclopropylmethyl)norhydromorphone; Nordihydrocodeine→N(cyclopropylmethyl)nordihydrocodeine; Nordihydromorphine→N(cyclopropylmethyl)nordihydromorphine; Nor-14-hydroxycodeine→N(cyclopropylmethyl)nor-14-hydroxycodeine; Nor-14-hydroxymorphine→N(cyclopropylmethyl)nor-14-hydroxymorphine; Norcodeineone→N(cyclopropylmethyl) norcodeineone; Normorphinone→N(cyclopropylmethyl) normorphinone; Nor-14-hydroxy-codeinone→N(cyclopropylmethyl)nor-14-hydroxycodeinone; and Nor-4-hydroxy-morphinone→N(cyclopropylmethyl)nor-14-hydroxymorphinone, among other reactions.

Figure 9:
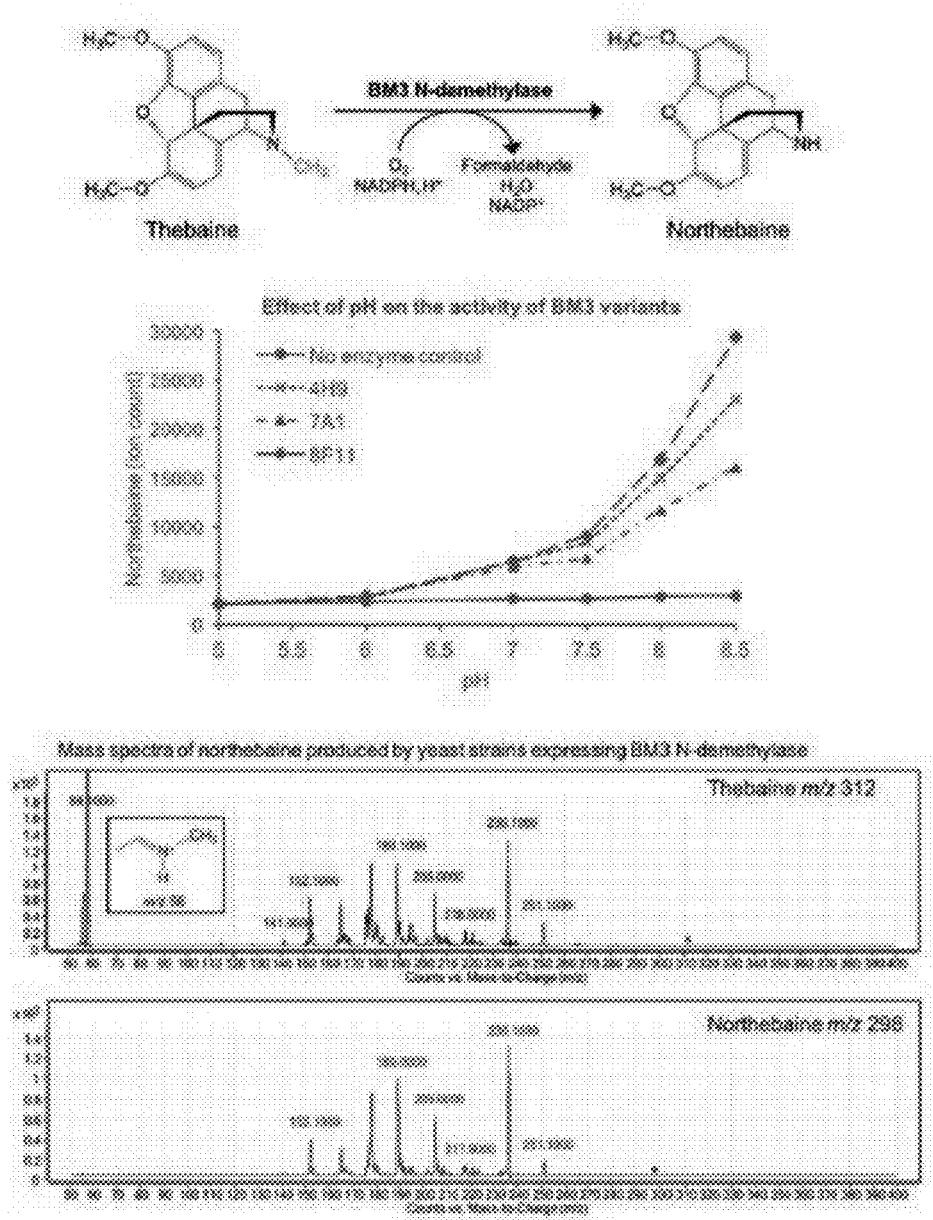
FIG. 9 illustrates the functional expression of BM3 variants, in accordance with embodiments of the invention.

[BM3] In some examples, the engineered host cell may express the enzyme BM3. BM3 is a *Bacillus megaterium* cytochrome P450 involved in fatty acid monooxygenation in its native host. In some cases BM3 N-demethylates an opioid to produce a nor-opioid, as referenced in FIG. 9. In some cases the host cell is modified to express BM3 in addition to other heterologous enzymes for the production of a nal-opioid or nor-opioid, as referenced in FIG. 10. The engineered host cell may be modified to include constitutive expression of the BM3 gene in the engineered host cell. Additionally or alternatively, the engineered host cell may be modified to synthetically regulate the expression of the BM3 gene in the engineered host cell. In examples, the engineered host cell may be modified to incorporate a copy, copies, or additional copies, of the BM3 gene. Additionally or alternatively, the engineered host cell may be modified to incorporate the introduction of a strong promoter element for the overexpression of the BM3 gene within the engineered host cell. BM3 has several advantages as a biosynthetic enzyme including that it is soluble, comes with a fused reductase partner protein, and can readily be engineered to accept new substrates. Additionally, Table 7 illustrates variants of BM3 N-demethylase.

Examples of the aforementioned genes can be expressed from a number of different platforms in the host cell, including plasmid (2µ, ARS/CEN), YAC, or genome. In addition, examples of the aforementioned gene sequences can either be native or codon optimized for expression in the desired heterologous host (e.g., *Saccharomyces cerevisiae*).

EXAMPLES

The following examples are given for the purpose of illustrating various embodiments of the invention and are not meant to limit the invention in any fashion. Where indicated, expression constructs are understood to incorporate a suitable promoter, gene, and terminator, even if the exact terminator sequence used is not specified. The present examples, along with the methods described herein are presently representative of preferred embodiments, are exemplary, and are not intended as limitations on the scope of the invention. Changes therein and other uses which are encompassed within the spirit of the invention as defined by the scope of the claims will occur to those skilled in the art.

Example 1. Intracellular Activity of Separately Expressed DRS and DRR is Substantially Higher than the Parental, Fused Enzyme The amino acid sequence of DRS-DRR from *P. bracteatum* (Farrow et al. 2015, GenBank: AKO60179.1) was codon-optimized (see, e.g., SEQ. ID 16) for expression in *S. cerevisiae* (codon optimization algorithm from IDT), and cloned into vectors with different promoter strengths to allow for protein engineering and enzyme improvement. The resulting plasmids, pDW10 and pDW18 (see FIG. 11), harbored DRS-DRR under control of the *S. cerevisiae* TDH3 promoter for strong expression and the CYC1 promoter for weak expression, respectively, and these were used as baseline constructs for future enzyme engineering efforts. The screening strain in this example was a derivative of YA106, an engineered *S. cerevisiae* Cen.PK strain expressing enzymes in the BIA pathway up to but not including DRS-DRR. Due to limitations in the high throughput differentiation of (S)-versus (R)-reticuline using LCMS methods, a strain expressing *P. bracteatum* SalSyn at high levels was constructed to screen for improved DRS-DRR enzymes based on the amount of salutaridine produced. SalSyn activity was empirically determined to be substantially higher than plasmid-based DRS-DRR activity, which allowed for increases in the conversion of (S)- to (R)-reticuline to be detected by the amount of salutaridine produced. Thus, improvements to DRS-DRR (or DRS alone) by protein engineering were measured by the relative concentration of salutardine in the culture medium. To ensure that plasmids did not integrate onto the chromosome upon transformation into the screening strain, the TRP1 locus was knocked out by integration of URA3 to yield DW24, the reporter strain used in this and subsequent examples.

For propagation of yeast strains harboring engineered DRS-DRR (or separate DRS and DRR) enzymes, the reporter strain was transformed with expression plasmids using standard molecular biology techniques, and single colonies of yeast were isolated from solid agar medium plates under selective conditions (such as synthetic complete 2% dextrose without tryptophan). Colonies were inoculated into liquid culture medium and grown for 2 days at 30° C. Cultures were then subcultured into fresh medium of the same composition, or in some cases into synthetic complete liquid medium containing 8% maltodextrin. To release monosaccharide from the maltodextrin polymer, amyloglucosidase from *A. niger* (Sigma) was added at a concentration of approximately 3 U/L. Yeast strains were grown for an additional 3 or 4 days at 30° C., cultures were separated by centrifugation, and salutaridine concentration was measured directly in the supernatant by LC-MS.

Plasmids and Strains

| Plasmid/Strain | Genotype |
| --- | --- |
| pDW10 | Spec$^R$, TRP, P$_{TDH3}$-PbDRS-DRR-T$_{CYC1}$ |
| pDW18 | Spec$^R$, TRP, P$_{CYC1}$-PbDRS-DRR-T$_{CYC1}$ |
| pDW21 | Spec$^R$, TRP, P$_{CYC1}$-PbDRS-T$_{ADH1}$-P$_{TFE1}$-PbDRR-T$_{CYC1}$ |
| pJL29 | Spec$^R$, TRP, P$_{TDH3}$-PbDRS-T$_{ADH1}$-P$_{TFE1}$-PbDRR-T$_{CYC1}$ |
| pJL32 | Spec$^R$, TRP, P$_{CYC1}$-PbDRS-T$_{ADH1}$-P$_{TDH3}$-PbDRR-T$_{CYC1}$ |
| pJL35 | Spec$^R$, TRP, P$_{TDH3}$-PbDRS-T$_{ADH1}$-P$_{CYC1}$-PbDRR-T$_{CYC1}$ |
| YA106 | S. cerevisiae Cen.PK, BIA pathway = NCS, CNMT, 6OMT, CYP80B1, CPR, 4OMT (complete genotype in Galanie et al. 2015) |
| YA511 | S. cerevisiae Cen.PK, BIA pathway = NCS, CNMT, 6OMT, CYP80B1, CPR, 4OMT, DRR, SalSyn, SalR, SalAT (complete genotype in Galanie et al. 2015) |
| DW6 | YA106, PbSalSyn(LEU+) |
| DW24 | YA106, PbSalSyn(LEU+), ΔTRP(URA3+) |

Figure 18:
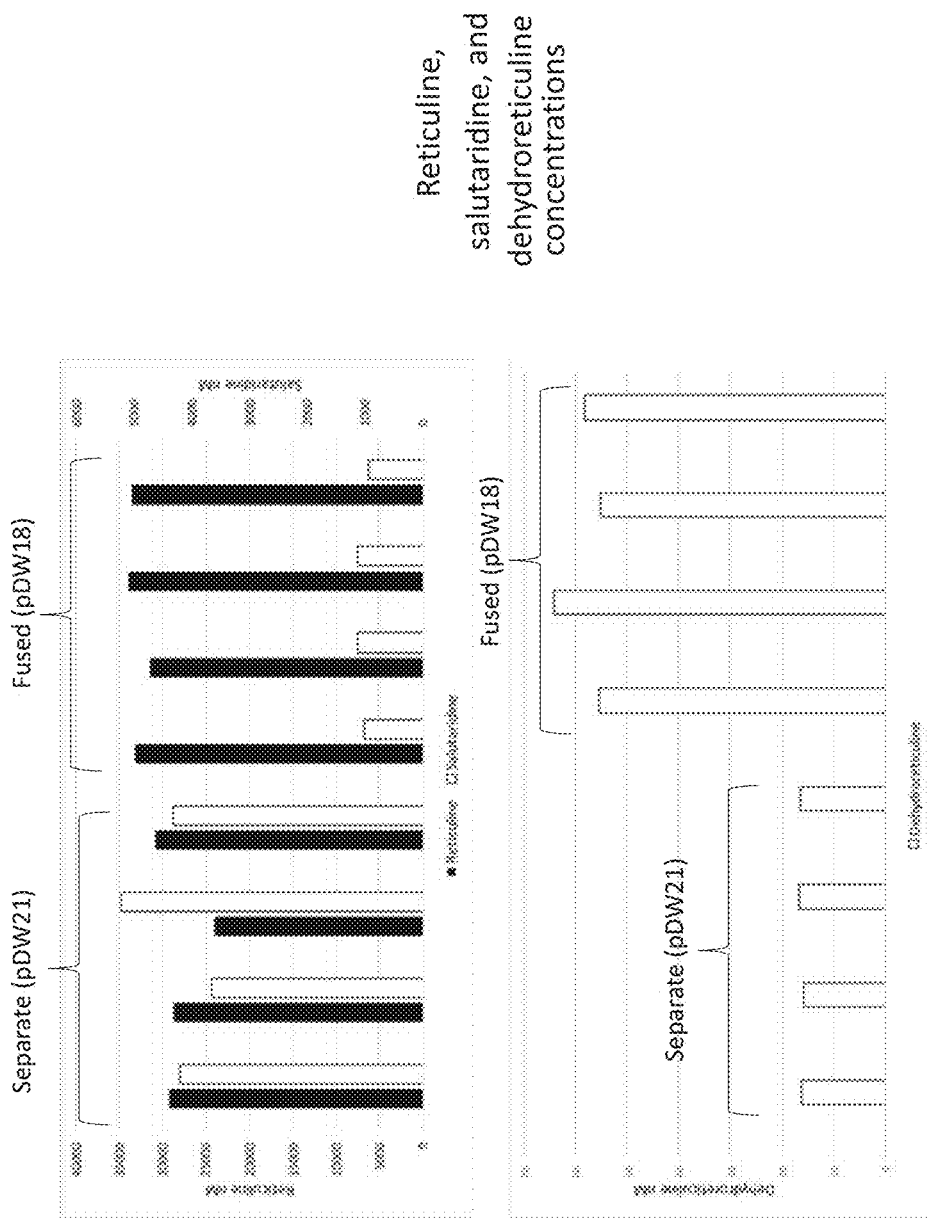
FIG. 18 illustrates expressing separated DRS and DRR produced greater amounts of salutaridine in comparison to the fused parent, in accordance with embodiments of the invention.

Unlike the morphinan alkaloid-producing poppy plants, which likely have highly specialized cell types for the synthesis of different metabolites in the BIA pathway (Onoyovwe et al., 2013), S. cerevisiae has just a single cell type, and the heterologous production of valuable compounds from this pathway requires that all enzymes, cofactors, and cellular machinery must work together in the same cell. To examine how the activities encoded in the wild-type fusion enzyme DRS-DRR function as separate enzymes in a heterologous system such as yeast, the cytochrome P450 (DRS) and the aldo-keto reductase (DRR) domains of the fused enzyme were split into two separate enzymes and expressed under different promoters. Using pDW18 as a template, the dehydroreticuline synthase (DRS) domain and the dehydroreticuline reductase (DRR) domain from DRS-DRR were cloned separately under the CYC1 and TEF1 promoters to yield plasmid pDW21, using standard molecular biology techniques. The pDW21 plasmid and the control plasmid harboring the parental fused DRS-DRR enzyme (pDW18) were separately transformed into the reporter strain. The strains were cultured and salutaridine production was measured directly in the supernatant via LC-MS analysis. FIG. 18 shows that in independent transformants, the levels of salutaridine (gray bars) produced from transformants harboring pDW21 are nearly 4 times higher than those from transformants harboring the control pDW18. The strains harboring pDW21 additionally exhibit a modest reduction in total reticuline (both S- and R-), and substantially less dehydroreticuline, in comparison to the control.

Figure 19:
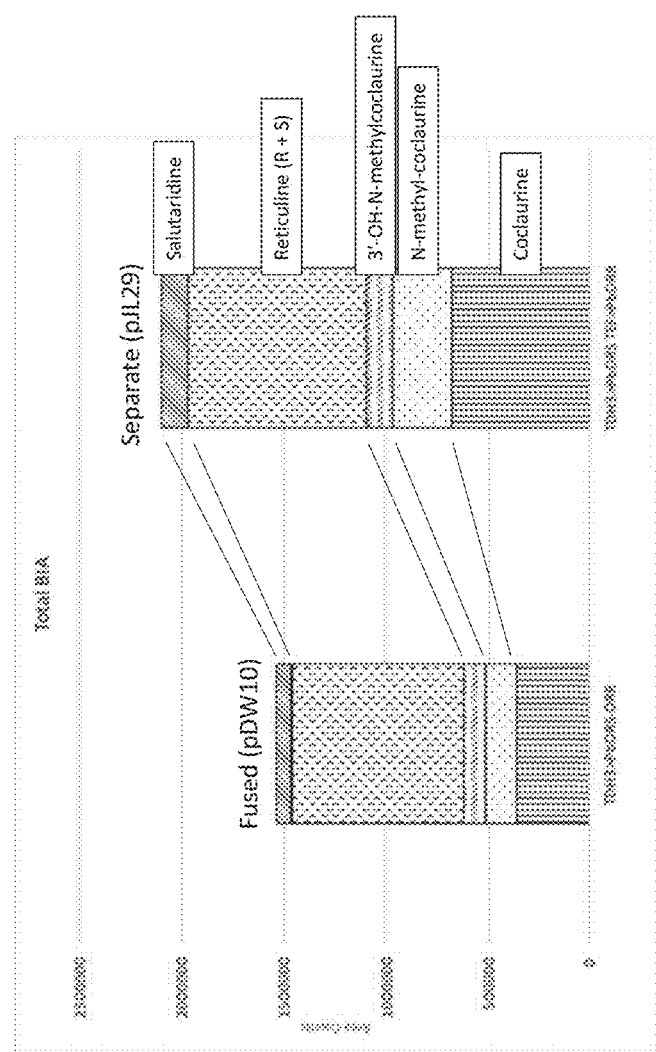
FIG. 19 illustrates the concentration of nearly all pathway intermediates was increased in the strain expressing separated DRS and DRR enzymes relative to the strain expressing the fused parent, in accordance with embodiments of the invention.

Example 2. Total BIA Levels are Increased in Strains Expressing DRS and DRR Separately in Comparison to the Parental, Fused Enzyme Detailed LC-MS analysis was carried out to examine the effect of the independent expression of DRS and DRR enzymes derived from DRS-DRR on the levels of multiple BIA pathway intermediates. For BIA intermediate detection, a plasmid harboring the separate DRS enzyme from DRS-DRR under the control of the TDH3 promoter and the separate DRR enzyme under the control of the TEF1 promoter (pJL29) was constructed for comparison to the parental, fused enzyme expressed from the pDW10 plasmid. Based on promoter strength, this plasmid provided the closest approximation of equivalent expression between the separated and fused enzymes. The plasmids were separately transformed into the S. cerevisiae reporter strain described in Example 1. The strains were cultured as described in Example 1 and BIA metabolites were measured directly in the supernatant via LC-MS analysis. As is shown in FIG. 19, the levels of nearly all BIA pathway intermediates are increased in the yeast strain harboring pJL29 in comparison to the strain harboring the control plasmid pDW10. Upstream pathway intermediates, in particular coclaurine and N-methylcoclaurine, were increased in the strain expressing the separate DRS and DRR enzymes relative to the strain expressing the fused DRS-DRR enzyme, which indicates greater overall pathway capacity in cells that express DRS and DRR separately. The levels of reticuline in this experiment were approximately the same, although Example 3 indicates that the majority of reticuline in this experiment was likely in the R-configuration. It is possible that the efficient conversion of S- to R-reticuline, and subsequent conversion to salutaridine, allow upstream enzymes to function better due to decreased product inhibition (from S-reticuline, for example) of their activity. Similar to the results shown in FIG. 18, cells expressing separate DRS and DRR enzymes produced greater amounts of salutaridine in comparison to cells expressing the fused parent DRS-DRR enzyme.

Example 3. Chiral Separation—Strains Expressing DRS and DRR Separately Produce Substantially More R-Reticuline than the Parental, Fused Enzyme Two yeast BIA pathway strains, derivates of YA106 described in Example 1, expressing either the parental, fused DRS-DRR or separate DRS and DRR enzymes, were analyzed for their ability to produce S- and R-reticuline. Reticuline was concentrated from yeast media by pelleting 12.5 mL yeast culture and adding 30 mg XAD-4 resin per mL supernatant, incubating on a rotator overnight at room temperature, and eluting with 100 μL methanol per mL supernatant. Samples were dried and resuspended in 100 μL water. The samples were fractionated by reverse-phase HPLC (Pursuit XRs-C 18, 50 mm×10 mm, 5 m) with isocratic 15% methanol.

Figure 20:
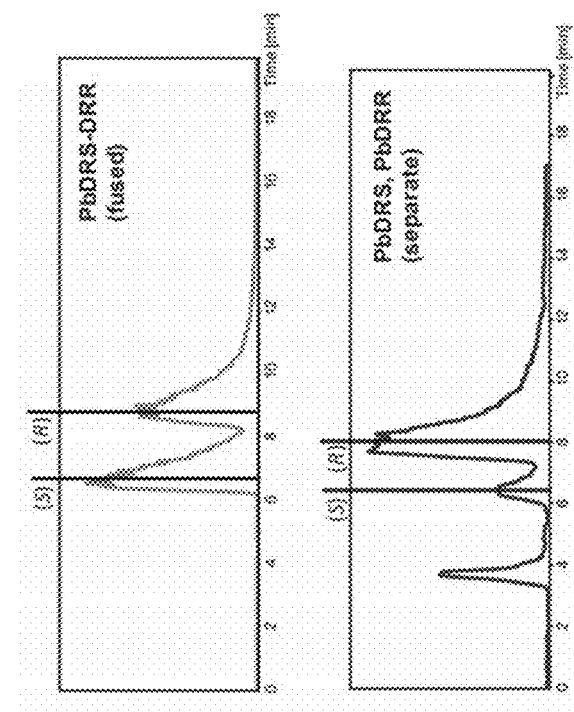
FIG. 20 illustrates chiral separation of reticuline, in accordance with embodiments of the invention.

Fractions were pooled, dried, and resuspended in isopropanol. Samples were separated on a chiral column (Phenomenex Lux cellulose-1, 150 mm×2 mm, 3 μm) with isocratic 72% N-hexane, 28% isopropanol, 0.1% diethylamine with a flow rate of 0.3 mL/min and MS detection was performed with an Agilent 6320 Ion Trap mass spectrometer. The retention time of reticuline peaks was compared to that of authentic (S)-reticuline and (R)-reticuline standards. The strain that expressed separate DRS and DRR enzymes produced more than 87% of total reticuline as (R)-reticuline, whereas the strain that expressed the fused, parental enzyme produced approximately 50% of each stereoisomer as shown in FIG. 20.

Example 4. Construction and Analysis of a Structural Model of DRS

Figure 22:
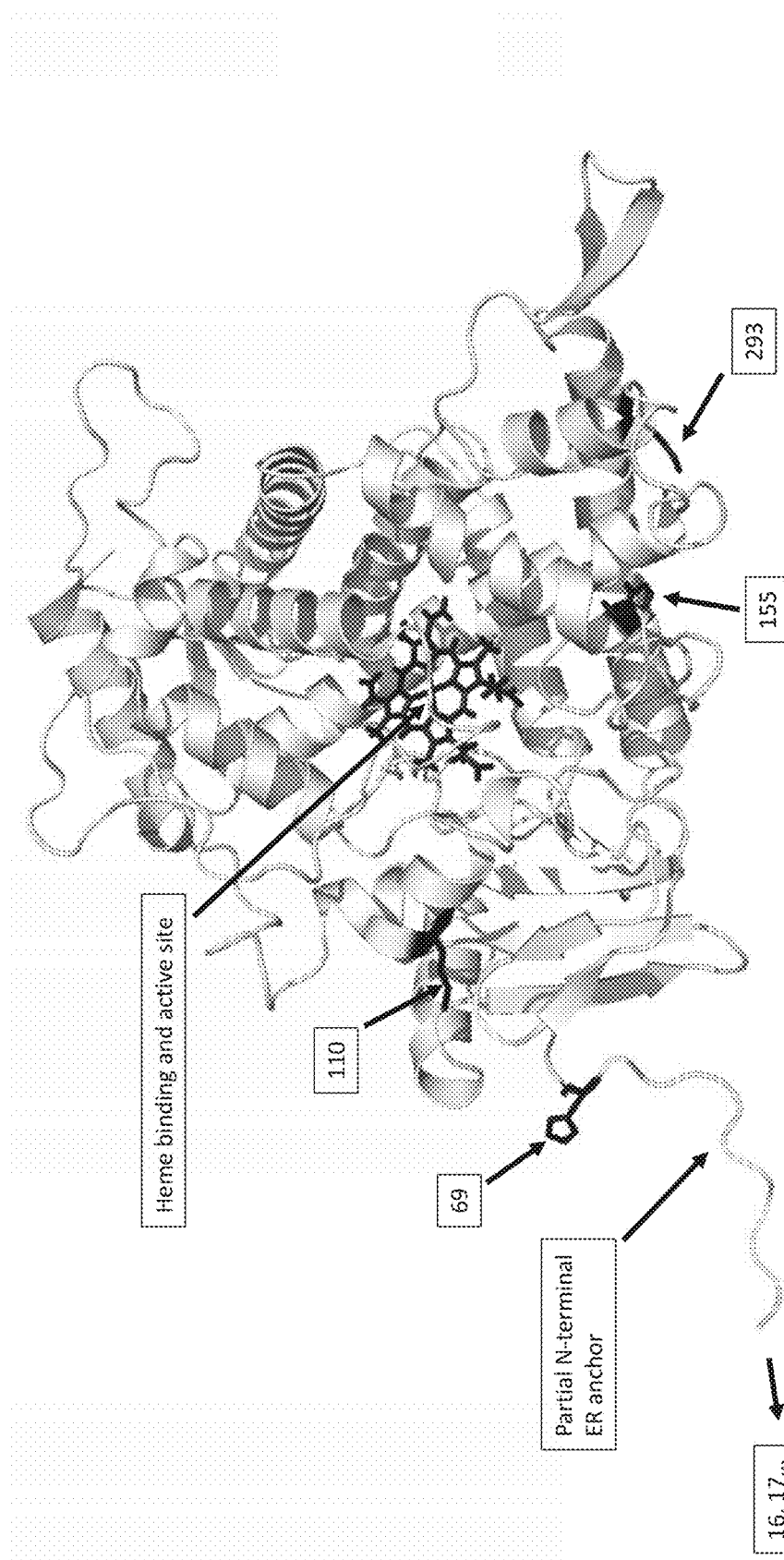
FIGS. 22 and 23 each illustrate a homology model of DRS based on 4NKX, in accordance with embodiments of the invention.
Figure 23:
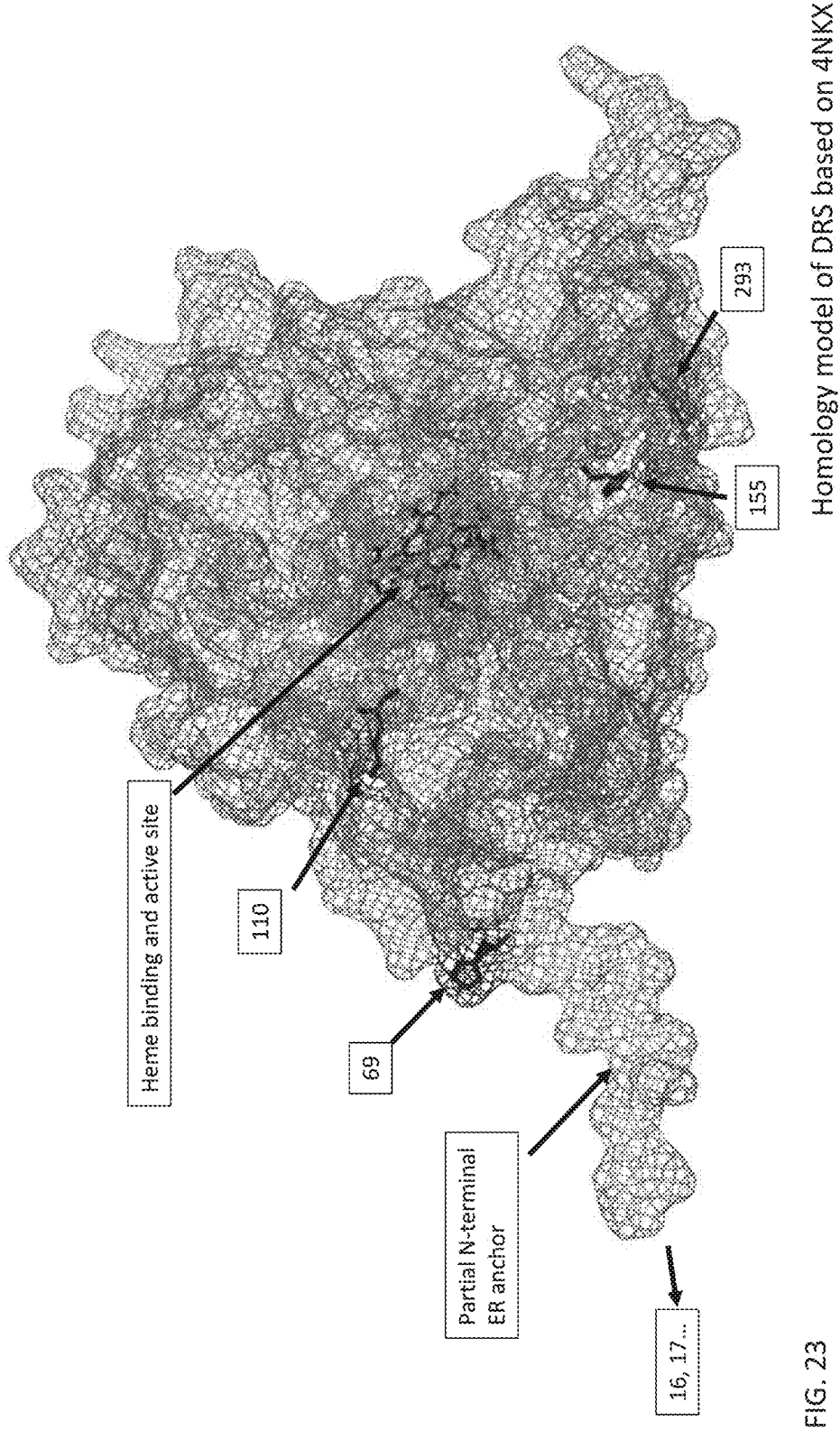

To better understand how the separate DRS enzyme folds and behaves mechanistically, and to build a framework for protein engineering efforts, structural homology models of DRS were constructed using the freely available SWISS-MODEL algorithm (https://swissmodel.expasy.org/). Two structural models, based on different CYP17 enzymes (PDBs 4NKX and 4R20), were constructed and analyzed in detail. The structural models based on these two different CYPs were nearly identical matches to each other, indicating broad structural homology between these types of cytochrome P450 molecules. Further, both models mapped the conserved EXXR motif and C-terminal cysteine residue (common to all P450s) of DRS in the identical location on the parent structure, suggesting the core structures of these molecules to be similar. FIGS. 22 and 23 show the structural model of DRS based on 4NKX. The residual N-terminal ER anchor domain can be seen in the bottom left of the figure, as well as the approximate location of the heme binding region (modeled from 4R20), which is close to the enzyme active site. The face of the model shown is the proposed general binding region for cytochrome P450 reductase (CPR) where electron transfer occurs, and the back side of the model as shown in FIGS. 22 and 23 are proposed to be proximal to the microsomal membrane. The homology model of DRS allows for potential functional roles to be assigned to any protein engineering improvements, based upon the position of residues and the amino acid changes that are identified.

Figure 21:
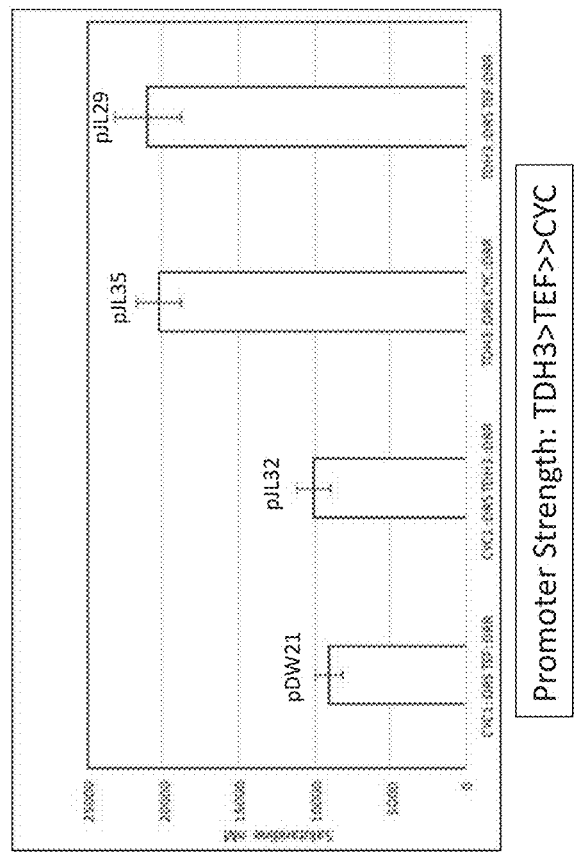
FIG. 21 illustrates when DRS expression is high (TDH3 promoter), and DRR expression is low (either CYC1 promoter), a maximum amount of salutaridine around 20 μM was produced, in accordance with embodiments of the invention.

Example 5. Intracellular DRS Activity is Rate Limiting in Comparison to DRR Activity Additional experiments were performed on the separate expression of DRS and DRR enzymes to determine which activity was limiting in a heterologous cell. To better understand which enzyme activity, that of either DRS or DRR, was rate-limiting, a series of vectors expressing both enzymes under different promoter strengths was constructed. Using pDW21 as a parental construct, the TDH3 promoter, which is stronger than the original TEF1 promoter, was inserted and used to drive the expression of DRR, resulting in plasmid pJL32. Also using pDW21 as a parental construct, the TDH3 promoter was inserted and used to drive DRS, resulting in plasmid pJL29. Using pJL29 as a parental construct, the CYC1 promoter, which is substantially weaker than TEF1, was inserted and used to drive DRR, resulting in plasmid pJL35. These plasmids were separately transformed in to the reporter yeast strain described in Example 1. The strains were cultured as described in Example 1 and BIA metabolites were measured directly in the supernatant via LC-MS analysis. FIG. 21 shows that when DRS expression is low (CYC1 promoter), and DRR expression is high (either TDH3 or TEF1), around 10 µM of salutaridine is produced from the yeast strains. However, when DRS expression is high (TDH3 promoter), it may not matter whether DRR expression is low (CYC1) or at intermediate levels (TEF1), as both constructs result in around 20 µM of salutaridine produced from the yeast strains, nearly double that observed from strains in which DRS is expressed at low levels. The results indicate that relative to DRR, the intracellular activity of DRS is limiting, and that additional protein engineering efforts can be applied to the DRS enzyme to further improve its activity.

Example 6. Mutagenesis and Identification of Improved DRS Variants

We performed mutagenesis-based enzyme engineering strategies to screen DRS libraries and identify improved DRS enzyme variants. The DRS open reading frame in pDW21 was subjected to error-prone PCR using the GeneMorph II (Agilent) random mutagenesis kit, according to the manufacturer's recommended protocol. Full-length, mutagenized PCR products of DRS were then either used as primers to directly reamplify and regenerate pDW21 plasmids, or recombined directly with linearized pDW21 using the Gibson Assembly kit (NEB), according to the manufacturer's recommended protocol. Resulting plasmids were then transformed into E. coli, and mutagenized pools of purified plasmids were purified and subsequently transformed into the S. cerevisiae reporter strain described in Example 1. Individual colonies were picked and cultured, and salutaridine levels were measured directly in the supernatant via LC-MS analysis. Approximately 5,000 independent variants were screened by LC-MS for increased production of salutaridine.

In comparison to control strains expressing wild type, non-mutagenized, parental DRS (DW24 harboring pDW21), strains expressing DRS variants that showed improved production of salutaridine were chosen for secondary screening and further study. The relative performance of each variant was determined by dividing salutaridine produced by the average salutaridine concentration from six independent replicates of the parental DRS expressed in the reporter strain. 25 variants that showed a fold change of 1.2× or higher than parental were pursued further. DNA shuffling of the improved variants and further screening was then used to isolate mutations that had a positive effect on activity from those that did not. For DNA shuffling, the NExT method (Mueller et al. 2005) was used as described, except DNA was digested with Endonuclease IV (NEB) and Phusion polymerase (NEB) was used for DNA amplification after reassembly. Shuffled variants were cloned into the pDW21 backbone and tested for salutaridine production in DW24 as described above.

Shuffled variants with improved activity over the parental sequence of DRS were sequenced (Quintara Biosciences) and mutations that showed the largest contribution to improved performance were identified. Table 13 lists all shuffle variants that displayed improved performance. All mutations present in Table 13 potentially result in increased activity of DRS relative to the parental sequence, but mutations that were identified in multiple improved shuffle variants or across multiple shuffle pools were determined most likely to result in direct improvements to DRS performance. The six sites satisfying these conditions were at positions 16, 17, 69, 110, 155, and 293.

When mapped onto the structural homology model of DRS based on CYP17A 1 (PDB number 4NKX), positions 16, 17, and 69 are all located in the N-terminal ER localization domain that is responsible for tethering this class of P450 enzymes to the microsomal membrane. Without being bound by theory, it is possible that changes at these residues affect not only how DRS interacts with and is embedded into the ER, but also the overall activity of DRS, since membrane localization and orientation are critical for enzyme function. Position 110 is a surface-exposed residue on the homology model, and is located on the face of the enzyme that is proposed to interact with cytochrome P450 reductase (CPR), an essential redox donor for P450 activity. Changes at this position may positively influence how DRS interacts with CPR, by facilitating electron transfer between the two enzymes, for example. Position 155 is also a surface-exposed residue that may play a role in how DRS interacts with CPR, and changes at this position could positively affect activity. Position 293 is another surface-exposed residue that is on the opposite face of the molecule from position 110, and is located near channels in the structural model that could allow for substrate or product accessibility. Residue changes at this position could influence how substrate binds or how product is released. Additionally, this face of the enzyme is proximal to the ER membrane surface, and changes here could impact how the enzyme interfaces with the microsome.

Figure 24:
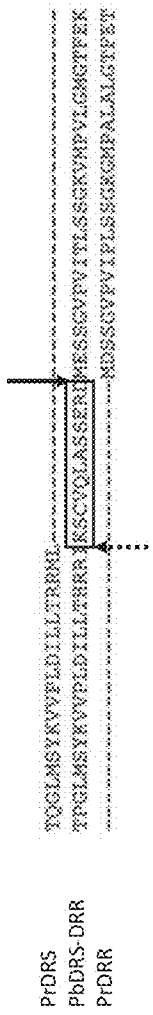
FIG. 24 illustrates an alignment between PbDRS-DRR (SEQ ID NO: 151), PrDRS (SEQ ID NO: 150), and PrDRR (SEQ ID NO: 152), in accordance with embodiments of the invention.

Example 7. The Amino Acid Positions at which PbDRS-DRR can be Truncated to Form Separate DRS and DRR Enzymes An alignment of the primary amino acid sequence of PbDRS-DRR versus dehydroreticuline synthase (DRS) and dehydroreticuline reductase (DRR) from *P. rhoeas* was generated using the Clustal Omega (http://www.ebi.ac.uk/Tools/msa/clustalo/) as shown in FIG. 24. Based on the alignment with DRR from *P. rhoeas*, we identified a truncation point at which to separate PbDRS-DRR into DRS and DRR enzymes, where a conserved methionine residue at position M569 is found (Seq. ID 16). This residue corresponds to position 1 of Seq. ID 18. The black arrow, between residues D568 and M569, represents the site at which PbDRS-DRR was truncated. The separate DRS enzyme based on PbDRS-DRR was designed to end at position D568. The dashed arrow points to a region of PbDRS-DRR that is not conserved with or homologous to either DRS or DRR from *P. rhoeas*. Truncations after each of these non-conservative residues, the sequence starting at K557 and ending at D568 within the black box, were generated, and the activity of each successive truncation of DRS was assayed in a vector backbone identical to pDW21 (with DRR under the control of the TEF1 promoter). These plasmids were separately transformed in to the reporter yeast strain described in Example 1. The strains were cultured as described in Example 1 and salutaridine was measured directly in the supernatant via LC-MS analysis.

Figure 25:
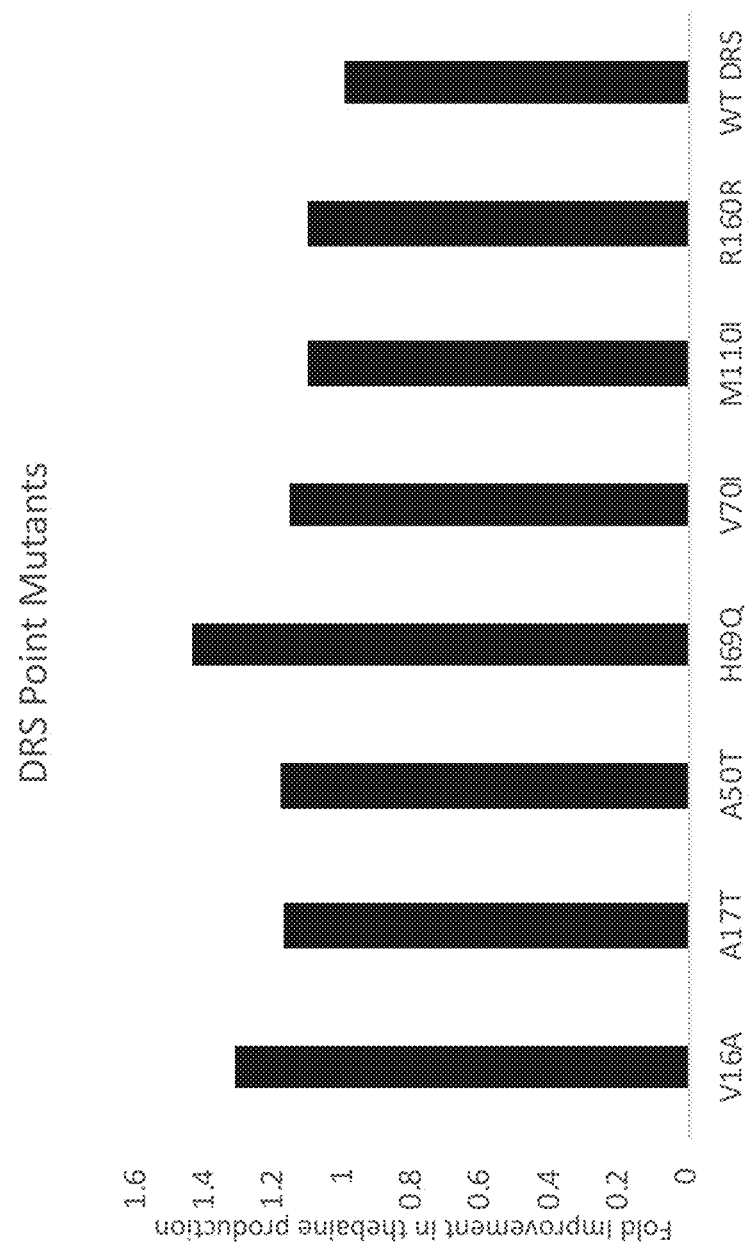
FIG. 25 illustrates expressing separated variants of DRS and DRR, wherein the DRS variant is engineered with enhancing mutations produced greater amounts of thebaine in comparison to the parent DRS variant, in accordance with embodiments of the invention.

Example 8. Identification of DRS Variants that Improve Production of the Morphinan Alkaloid Thebaine Mutations in 30 unique residues were identified in the DRS enzyme that improved epimerase activity in yeast and resulted in higher titers of salutaridine, a promorphinan alkaloid (see Example 6). The impact of several of these mutations on DRS activity and thebaine production were verified by cloning selected point mutations in DRS into plasmids. The point mutations selected for analysis were V16A, A17T, A50T, H69Q, V70, M110I, and R160R (codon change). These plasmids were transformed into the screening strain yA511. yA511 is engineered with a complete biosynthetic pathway to thebaine, but lacks a functional DRS enzyme. Transformed colonies were picked in to pre-culture growth medies and grown overnight as described in Example 1. Cells were backdiluted in to production media. After two days of production growth, supernatants from the cultures were isolated and measured using LC-MS/MS analysis. Cells expressing the DRS mutant variants accumulated up to 1.4 fold more thebaine in the culture medium compared to the control strain expressing wild type (WT) DRS (FIG. 25).

Figure 26:
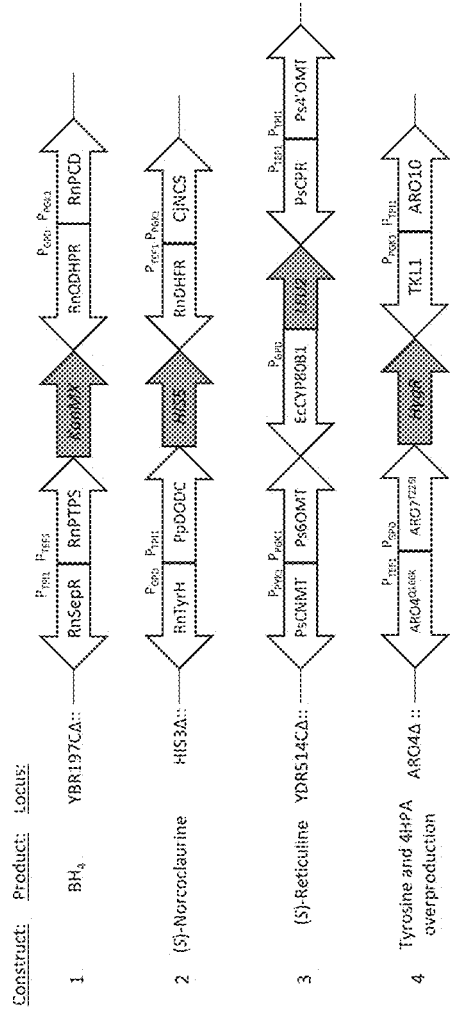
FIG. 26 illustrates yeast platform strains for the production of reticuline from L-tyrosine, in accordance with embodiments of the invention.

Example 9: Platform Yeast Strains Engineered to Produce (S)-Reticuline from Glucose and Simple Nitrogen Sources A platform yeast strain that produces the key branch point BIA intermediate (S)-reticuline from L-tyrosine was constructed (FIG. 12). Specifically, four multi-gene expression constructs were integrated into the genome of a yeast strain. The composition of the four constructs is indicated in FIG. 26. Each construct is comprised of 4 or 5 genes expressed from yeast promoters. Genes are positioned at each locus as complete expression cassettes comprising a promoter, gene open reading frame, and terminator as specified in the annotations above the schematic. The schematic shows the orientation of each expression cassette by the direction of the arrow representing a given gene. Selectable markers are italicized in the annotation and represented by grey arrows in the schematic. Each selection marker is flanked by loxP sites to allow removal of the marker from the locus. Additionally, each construct has a selectable marker flanked by loxP sites so that it can be removed by Cre recombinase.

In the first integration construct, four heterologous genes from *Rattus norvegicus* are integrated into the YBR197C locus together with a G418 selection marker (KanMX). RnPTPS, RnSepR, RnPCD, and RnQDHPR are required to synthesize and regenerate tetrahydrobiopterin ($BH_4$) from the yeast endogenous folate synthesis pathway as indicated in FIG. 1. Each gene is codon optimized for expression in yeast.

In the second integration construct, four heterologous genes are integrated into the HIS3 locus together with the HIS5 selection marker. *Rattus norvegicus* tyrosine hydroxylase (RnTyrH) converts tyrosine to L-DOPA using the cosubstrate $BH_4$ generated by the preceding integration construct. The RnTyrH gene can be any of the wild-type or improved mutants which confer enhanced activity (e.g., W166Y, R37E, and R38E). A second *Rattus norvegicus* gene, RnDHFR, encodes an enzyme that reduces dihydrobiopterin (an oxidation product of $BH_4$) to $BH_4$, in this way increasing the availability of this cosubstrate. Also included in the third construct is PpDODC from *Pseudomonas putida*, an enzyme that converts L-DOPA to dopamine. The fourth enzyme is CjNCS from *Coptis japonica*, which condenses 4-HPA and dopamine to make norcoclaurine. Each gene is codon optimized for expression in yeast.

In the third integration construct, five heterologous genes from plants and the LEU2 selection marker are integrated into the locus YDR514C. Ps6OMT, Ps4'OMT, and PsCNMT are methyltransferases from *Papaver somniferum* and are expressed as native plant nucleotide sequences. A fourth *P. somniferum* gene, yPsCPRv2, is codon optimized for yeast and encodes a reductase that supports the activity of a cytochrome P450 from *Eschscholzia californica*, EcCYP80A1. The enzymes encoded in this construct perform two O-methylations, an N-methylation, and a hydroxylation to produce reticuline from the norcoclaurine produced by the preceding integration construct. Each gene is codon optimized for expression in yeast.

In the final integration construct, additional copies of *Saccharomyces cerevisiae* endogenous genes $ARO4^{Q166K}$, $ARO7^{T226I}$, TYR1, and ARO10 are integrated into the ARO4 locus together with a hygromycin resistance selection marker. $ARO4^{Q166K}$ and $ARO7^{T226I}$ are feedback-resistant mutants of ARO4 and ARO10 which each encode a single base pair substitution relative to the wild-type sequence. TYR1 and ARO10 are identical to the native yeast genes, but are expressed behind strong promoters. Aro4p and Aro7p are enzymes in the biosynthesis of aromatic amino acids including tyrosine. Removing feedback inhibition from these enzymes results in upregulation of endogenous tyrosine biosynthesis. Overexpression of Tyr1p upregulates tyrosine biosynthesis and thus production of tyrosine. Overexpression of Aro10p increases the production of 4-HPA.

Platform yeast strains can be constructed with any number of the four expression cassettes. Specifically, platform yeast strains were constructed with integration constructs 1-4 and integration constructs 1-3. In the latter strain in which the tyrosine over-production construct (construct 4) is excluded, additional tyrosine may be supplied in the culture medium to support the biosynthesis of reticuline. Additional genetic modifications may be incorporated into the platform strains to support production of downstream BIAs and increased flux to BIA biosynthesis.

The yeast strains were grown in synthetic complete media with the appropriated amino acid drop out solution at 30° C. BIA metabolites in the media supernatant were analyzed after 48 and 96 hours of growth by LC-MS/MS analysis.

Example 10: Platform Yeast Strains Engineered to Produce Thebaine from Glucose and Simple Nitrogen Sources Yeast strains can be engineered for the production of the morphinan alkaloid thebaine from early precursors such as tyrosine. As an example, the platform yeast strains described in Example 9 can be further engineered to produce the morphinan alkaloid products from L-tyrosine (FIG. 14).

Figure 27:
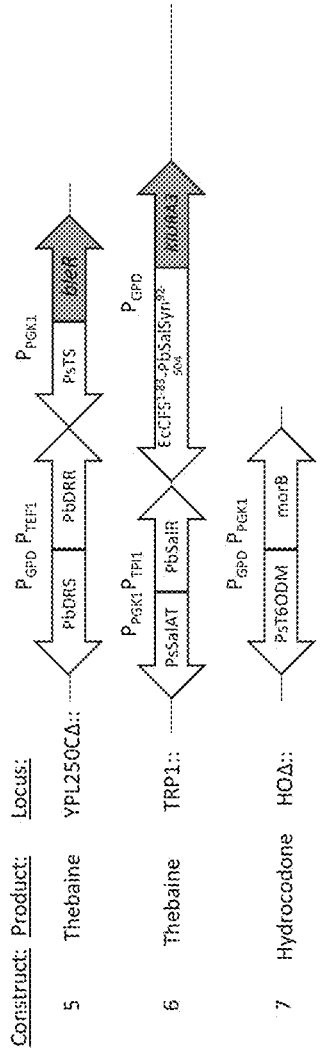
FIG. 27 illustrates yeast strains for the production of thebaine and hydrocodone from L-tyrosine, in accordance with embodiments of the invention.

The platform yeast strain producing (S)-reticuline from L-tyrosine (see description in Example 9) was further engineered to incorporate an engineered split epimerase DRS and DRR, an engineered salutaridine synthase, salutaridine reductase, salutaridinol acetyltransferase, and thebaine synthase to convert the biosynthesized (S)-reticuline to the first morphinan alkaloid thebaine (FIG. 14). Three expression cassettes ($P_{TDH3}$-yEcCFS$^{1-26}$-PbSS$^{33-504}$, $P_{TPI1}$-yPbSalR, $P_{TEF1}$-yPsSalAT) were assembled into an integration construct with a bleR selective marker and integrated into the locus TRP1 in the platform yeast strain. An additional three expression cassettes ($P_{TDH3}$yPbDRS, $P_{TEF1}$-yPbDRR, $P_{PGK1}$-YPTS) were assembled into an integration construct with a URA3 selective marker and integrated into the locus YPL250CΔ in the platform yeast strain. The composition of the two constructs is indicated in FIG. 27.

The yeast strains harboring the integrated cassettes were grown in synthetic complete media with the appropriated drop out solution at 30° C. After 96 hours of growth, the media was analyzed for BIA metabolites by LC-MS/MS analysis.

Example 11: Production of Thebaine from Glucose and Simple Nitrogen Sources Via Engineered Yeast Strains Yeast strains were engineered as described in Examples 9 and 10 to produce the pentacyclic morphinan alkaloid thebaine directly from simple sugars (e.g., glucose) and nitrogen sources present in standard growth media. Specifically, a CEN.PK strain of Saccharomyces cerevisiae was engineered to express the following heterologous enzymes via integration into the yeast chromosome: TyrH, DODC, PTPS, SepR, PCD, QDHPR, NCS, 6OMT, CNMT, CYP80B1, CPR, 4OMT, DRS, DRR, SalSyn, SalR, SalAT, and TS. In this example, the SalSyn enzyme is engineered to have its leader sequence replaced with 83 amino acids from the N-terminus of Eschscholzia californica chelanthifoline synthase (EcCFS). Additional modifications were made to the strain to increase BIA precursor accumulation, including: overexpression of ARO10, overexpression of TYR1, expression of a feedback resistant ARO4 (ARO4$^{Q166K}$), and expression of a feedback resistant ARO7 (ARO7$^{T226I}$). Separate engineered yeast strains were made as described, harboring different variants of enzymes encoding thebaine synthase activity (TS), including SEQ ID NOs. 35 (i.e., TS1), 37 (i.e., TS2), and a variant of 35 with a N-terminal truncation of the first 22 amino acids (i.e., tTS1), and no thebaine synthase enzyme (YA397). The sequences of the enzyme variants are provided in Table 2.

Figure 29:
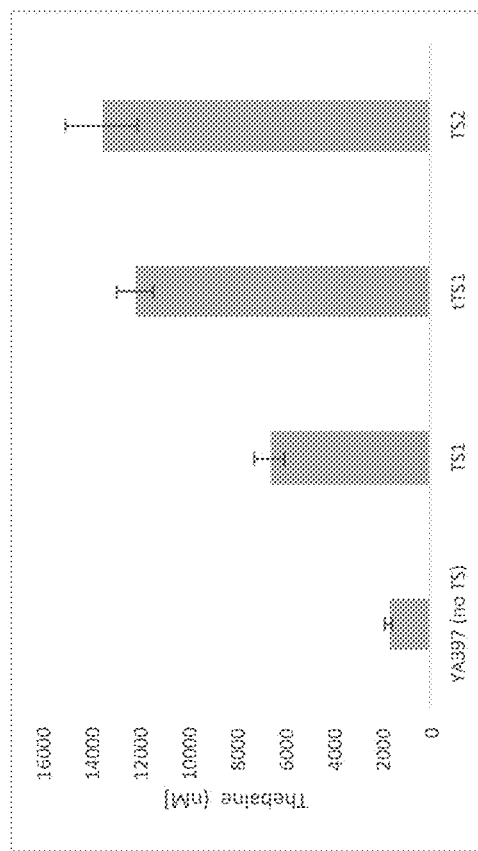
FIG. 29 illustrates the production of the morphinan alkaloid thebaine from sugar and L-tyrosine from an engineered yeast strain, in accordance with embodiments of the invention.
Figure 30:
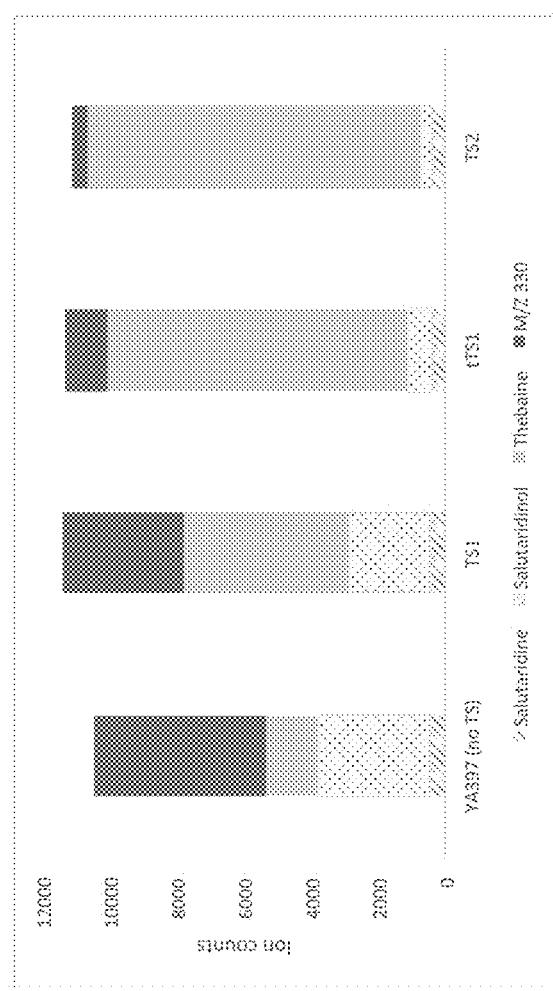
FIG. 30 illustrates the production of promorphinan alkaloids and a morphinan alkaloid thebaine from sugar and L-tyrosine from an engineered yeast strain, in accordance with embodiments of the invention.

The described yeast strains were inoculated into 2 ml of synthetic complete media (yeast nitrogen base and amino acids) with 2% glucose and grown for approximately 4 hours at 30° C. Then, 10 uL of each culture was transferred to 400 uL of fresh media in a 96-well plate in replicates of 4 and grown for an additional 48 hours at 30° C. The production media contains 1× yeast nitrogen broth and amino acids, 20 mM ascorbic acid, 300 mg/L tyrosine, 40 g/L maltodextrin, and 2 units/L amylase. The amylase is used to mimic a fed-batch process and gradually releases glucose from maltodextrin polymer so that the yeast can use it as a carbon source. The cells were separated from the media by centrifugation, and thebaine concentration was measured directly in the supernatant by LC-MS/MS analysis. All engineered yeast strains produced thebaine from glucose and simple nitrogen sources present in the growth media (FIGS. 29 and 30). Strains harboring a thebaine synthase activity produced higher levels of thebaine relative to strains not harboring this activity under the described fermentation conditions.

Example 12: Yeast Strains Engineered to Produce Downstream Morphinan Alkaloids from Glucose and Simple Nitrogen Sources Yeast strains can be engineered for the production of the downstream morphinan alkaloids from early precursors such as tyrosine. As an example, the platform yeast strains described in Example 10 can be further engineered to produce the downstream morphinan alkaloid products from L-tyrosine (FIG. 14).

The platform yeast strain producing thebaine from L-tyrosine (see description in Example 10) was further engineered to incorporate thebaine 6-O-demethylase, codeinone reductase, and codeinone-O-demethylase to convert the biosynthesized thebaine to the downstream morphinan alkaloids including morphine (FIG. 14). Three expression cassettes ($P_{ADH1}$-T6ODM-$T_{ADH1}$, $P_{HXT7}$-COR-$T_{PGK1}$, $P_{TEF1}$-CODM-$T_{CYC1}$) were directly assembled with a TRP1 selective marker and integrated into the trp1 locus in the thebaine platform yeast strain (Thodey et al., 2014).

The yeast strains harboring the integrated cassettes were grown in synthetic complete media with the appropriated drop out solution at 30° C. After 96 hours of growth, the media was analyzed for BIA metabolites by LC-MS/MS analysis.

Example 13: Yeast Strains Engineered to Produce Semi-Synthetic Opioids from Glucose and Simple Nitrogen Sources Yeast strains can be engineered for the production of the downstream morphinan alkaloids from early precursors such as tyrosine. As an example, the yeast strains described in Examples 9 and 10 can be further engineered to produce the semi-synthetic opioid products from L-tyrosine (FIG. 15).

The yeast strains producing downstream morphinan alkaloids from L-tyrosine (see description in Example 10) were further engineered to incorporate morphine dehydrogenase and morphinone reductase to convert the biosynthesized thebaine to the downstream morphinan alkaloids including morphine (FIG. 15). Two expression cassettes ($P_{GPD}$-morA-$T_{CYC1}$, $P_{PGK1}$-morB-$T_{PHO5}$) were directly assembled with a KanMX selective marker and integrated into the HO locus in the downstream morphinan alkaloids producing yeast strains (Thodey et al., 2014).

The yeast strains harboring the integrated cassettes were grown in synthetic complete media with the appropriated drop out solution at 30° C. After 96 hours of growth, the media was analyzed for BIA metabolites by LC-MS/MS analysis.

Example 14: Microbial Strains Engineered to Produce O-Demethylated Opioid Compounds from Glucose and Simple Nitrogen Sources Enzymes listed in Table 4 that displayed O-demethylase activity on morphinan alkaloids, were incorporated into a microbial strain (either *Saccharomyces cerevisiae* or *Escherichia coli*) which biosynthesizes morphinan alkaloids de novo (as described in Example 10). The complete BIA biosynthetic pathway uses L-tyrosine produced by the host cell and/or supplemented in the culture medium. Two molecules oftyrosine are modified and condensed to form the first benzylisoquinoline structure, which may be either norcoclaurine or norlaudanosoline. The benzylisoquinoline is further modified to form (S)-reticuline and then stereochemically inverted by the activity of an engineered split epimerase enzyme to yield (R)-reticuline. (R)-reticuline undergoes a carbon-carbon coupling reaction to form the first promorphinan, salutaridine, and is further modified before undergoing an oxygen-carbon coupling reaction catalyzed by a thebaine synthase to arrive at the first morphinan alkaloid structure, thebaine (see FIG. 14). Table 3 lists enzymes and activities in the complete pathway.

Figure 10:
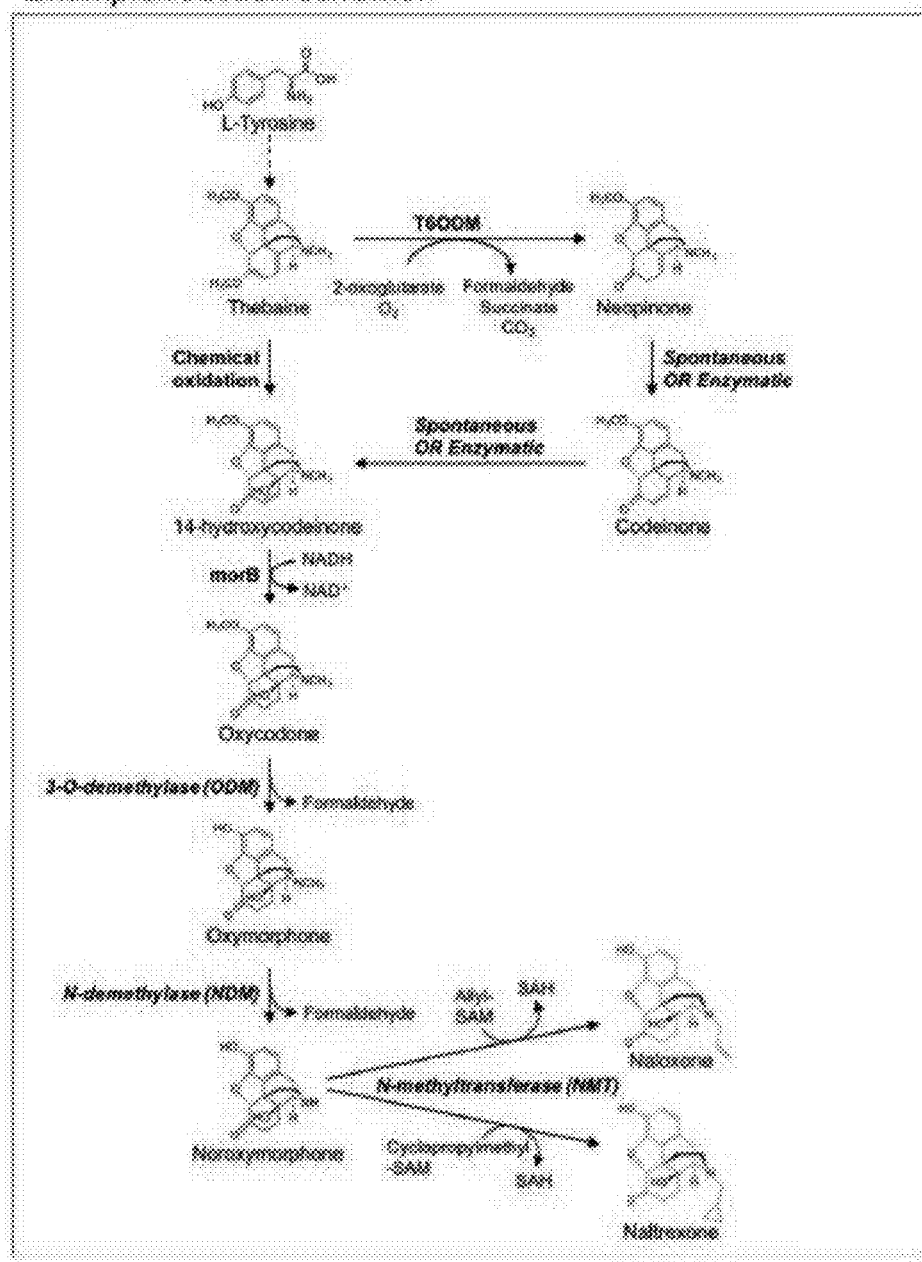
FIG. 10 illustrates a biosynthesis scheme for conversion of L-tyrosine to a nor-opioid or nal-opioid in a microbial cell, in accordance with embodiments of the invention.

FIG. 10 illustrates a biosynthesis scheme in a microbial cell, in accordance with embodiments of the invention. Tyrosine produced endogenously by the cell and/or supplied in the culture medium is converted to oxycodone (broken arrows represent multiple enzymatic steps). The oxycodone is then 3-O-demethylated to oxymorphone and N-demethylated to noroxymorphone. Finally, an N-methyltransferase accepts allyl and cyclopropylmethyl carbon moieties from SAM analogues to produce naloxone and naltrexone, respectively.

To detect O-demethylase activity in strains producing morphinan alkaloid molecules, cells expressing candidate enzymes, either from plasmid vectors or chromosomally-integrated cassettes, were propagated by fermentation and cell supernatants were collected to analyze the total opioid profile (as described above). 0-demethylation of opioid molecules in strains harboring the complete BIA pathway was detected by LC-MS (as described above). Specifically, the conversion ofoxycodone to oxymorphone was detected. To detect O-demethylation activity via biocatalysis, strains were cultured in selective medium and then lysed by glass bead disruption. Cell lysates were supplied exogenously with opioid substrates (see FIG. 6), and other cofactors necessary for enzyme function. O-demethylation of opioid molecules was detected by LC-MS.

Example 15: Microbial Strains Engineered to Produce N-Demethylated Opioid Compounds from Glucose and Simple Nitrogen Sources Enzymes listed in Table 5, that displayed N-demethylase activity on morphinan alkaloids, were incorporated into a microbial strain (either *Saccharomyces cerevisiae* or *Escherichia coli*) which biosynthesizes morphinan alkaloids de novo (as described in Example 10). The complete BIA biosynthetic pathway uses L-tyrosine produced by the host cell and/or supplemented in the culture medium. Two molecules oftyrosine are modified and condensed to form the first benzylisoquinoline structure which may be either norcoclaurine or norlaudanosoline. The benzylisoquinoline is further modified to form (S)-reticuline and then stereochemically inverted by the activity of an engineered split epimerase enzyme to yield (R)-reticuline. (R)-reticuline undergoes a carbon-carbon coupling reaction to form the first promorphinan, salutaridine, and is further modified before undergoing an oxygen-carbon coupling reaction catalyzed by a thebaine synthase to arrive at the first morphinan alkaloid structure, thebaine (see FIG. 14). Table 3 lists enzymes and activities in the complete pathway.

To detect N-demethylase activity in strains producing morphinan alkaloid molecules, cells expressing candidate enzymes, either from plasmid vectors or chromosomally-integrated cassettes, were propagated by fermentation and cell supernatants were collected to analyze the total opioid profile (as described above). N-demethylation of opioid molecules in strains harboring the complete BIA pathway was detected by LC-MS (as described above). Specifically, the conversion oxymorphone to noroxymorphone was detected. To detect N-demethylation activity via biocatalysis, strains were cultured in selective medium and then lysed by glass bead disruption. Cell lysates were supplied exogenously with opioid substrates (see FIG. 7), and other cofactors necessary for enzyme function. N-demethylation of opioid molecules was detected by LC-MS.

Example 16: Microbial Strains Engineered to Produce Nal-Opioid Compounds from Glucose and Simple Nitrogen Sources Enzymes listed in Table 6, that displayed N-methylase activity on morphinan alkaloids, were incorporated into a microbial strain (either *Saccharomyces cerevisiae* or *Escherichia coli*) which biosynthesizes morphinan alkaloids de novo (as described in Example 10). FIG. 10 shows an example of the complete reaction scheme from the precursor molecule thebaine to the final nal-opioid compounds naloxone and naltrexone. These strains additionally express enzymes from Examples 14 and 15 and Table 3, that are responsible for generating nor-opioid compounds from the complete BIA pathway. N-methylase enzymes were also expressed in a microbial strain (either Cen.PK2 for *S. cerevisiae* or BL21 for *E. coli*, for example) lacking the biosynthetic pathway, to generate a strain that is capable of biocatalysis of several different exogenously-supplied substrate molecules. The complete BIA biosynthetic pathway uses tyrosine produced by the host cell and/or supplemented in the culture medium. Two molecules oftyrosine are modified and condensed to form the first benzylisoquinoline structure which may be either norcoclaurine or norlaudanosoline. The benzylisoquinoline is further modified to form (S)-reticuline and then stereochemically inverted by the activity of an engineered split epimerase enzyme to yield (R)-reticuline. (R)-reticuline undergoes a carbon-carbon coupling reaction to form the first promorphinan, salutaridine, and is further modified before undergoing an oxygen-carbon coupling reaction catalyzed by a thebaine synthase to arrive at the first morphinan alkaloid structure, thebaine (see FIG. 14). Table 3 lists enzymes and activities in the complete pathway.

To detect N-modifying activity in strains with the complete BIA pathway to nor-opioids (see FIG. 10), cells expressing candidate enzymes were propagated by fermentation (as described above) and incubated with SAM or SAM analogs, such as those listed in FIG. 8. Enzymatic modification of nor-opioid or other BIA molecules in strains harboring the complete BIA pathway was detected in supernatants by LC-MS (as described above). To detect N-modifying activity via biocatalysis, strains were cultured in selective medium and then lysed by glass bead disruption. Cell lysates were supplied exogenously with SAM or SAM analogs, and other cofactors necessary for enzyme function. Specifically, the conversion of noroxymorphone to naloxone and naltrexone (using the SAM analogs allyl-SAM or cyclopropane-SAM, as shown in FIG. 8) was detected. Modification of nor-opioid or other BIA molecules was detected by LC-MS. To detect N-modifying activity by biocatalysis in a strain that does not have the complete BIA pathway, Cen.PK2 strains expressing the described heterologous enzymes were grown in selective medium and lysed by glass bead disruption. Cell lysates were supplied exogenously with SAM or SAM analogs, cofactors necessary for enzyme function, and nor-opioid molecules such as those listed in FIG. 8 and Table 3. Modification of these compounds was detected by LC-MS.

TABLE 3

List of enzymes

| Enzyme | Abbrev | Catalyzed Reactions | Source organisms | Genbank # |
|---|---|---|---|---|
| Transketolase | TKL1 | fructose-6-phosphate + glyceraldehyde-3-phosphate ↔ xylulose-5-phosphate + erythrose-4-phosphate (EC 2.2.1.1) | Saccharomyces cerevisiae | NP_015399.1 |
| Glucose-6-phosphate dehydrogenase | ZWF1 | glucose-6-phosphate → 6-phosphogluconolactone (EC 1.1.1.49) | Saccharomyces cerevisiae | CAA96146.1 |
| Prephenate dehydrogenase | TYR1 | prephenate + $NADP^+$ → 4-hydroxyphenylpyruvate + $CO_2$ + NADPH (EC 1.3.1.13) | Saccharomyces cerevisiae | CAA85127.1 |
| 3-deoxy-d-arabinose-heptulosonate-7-phosphate synthase | ARO4, DAHP synthase | erythrose-4-phosphate + PEP → DAHP (EC 2.5.1.54) | Saccharomyces cerevisiae | CAA85212.1 |
| Chorismate mutase | ARO7 | chorismate → prephenate (EC 5.4.99.5) | Saccharomyces cerevisiae | NP_015385.1 |
| Phenylpyruvate decarboxylase | ARO10 | hydroxyphenylpyruvate → 4HPA (EC 4.1.1.80) | Saccharomyces cerevisiae | NP_010668.3 |
| Alcohol dehydrogenase | ADH2-7, SFA1 | 4HPA → tyrosol (EC 1.1.1.90) | Saccharomyces cerevisiae | NP_014032.1, AAT93007.1, NP_011258.2, NP_009703.3, NP_014051.3, NP_010030.1, NP_010113.1 |
| Aldehyde oxidase | ALD2-6 | 4HPA → hydroxyphenylacetic acid (EC 1.2.1.39) | Saccharomyces cerevisiae | NP_013893.1, NP_013892.1, NP_015019.1, NP_010996.2, NP_015264.1 |
| Aryl-alcohol dehydrogenase | AAD4, 6, 10, 14-16 | aromatic aldehyde + $NAD^+$ → aromatic alcohol + NADH (EC 1.1.1.90) | Saccharomyces cerevisiae | GAX67600, GAX72034, AAT93180, AAS56234, NP_012689, GAX69843, NP_014477, AAS56127 |
| Aromatic aminotransferase | ARO9 | hydroxyphenylpyruvate + L-alanine ↔ tyrosine + pyruvate (EC 2.6.1.58) | Saccharomyces cerevisiae | AEC14313.1 |
| Aromatic aminotransferase | ARO8 | hydroxyphenylpyruvate + glutamate ↔ tyrosine + alpha-ketogluterate (EC 2.6.1.5) | Saccharomyces cerevisiae | KZV11027.1 |
| Tyrosinase | TYR | tyrosine → L-DOPA, L-DOPA → dopaquinone (EC 1.14.18.1) | Ralstonia solanacearum, Agaricus bisporus | NP_518458.1, AJ223816, |
| Tyrosine hydroxylase | TyrH | tyrosine → L-DOPA (EC 1.14.16.2) | Homo sapiens, Rattus norvegicus, Mus musculus | NM 012740, NM 000240 |
| L-DOPA decarboxylase | DODC | L-DOPA → dopamine (EC 4.1.1.28) | Pseudomonas putida, Rattus norvegicus | AE015451.1, NP_001257782.1 |
| Tyrosine/DOPA decarboxylase | TYDC | L-DOPA → dopamine (EC 4.1.1.28) tyrosine →tyramine (EC 4.1.1.25) | Papaver somniferum | AAA97535 |
| Monoamine oxidase | MAO | dopamine → 3,4-DHPA (EC 1.4.3.4) | E. coli, Homo sapiens, Micrococcus luteus | J03792, D2367, AB010716.1 |
| Norcoclaurine synthase | NCS | 4HPA + dopamine → S- norcoclaurine (EC 4.2.1.78) 3,4-DHPA + dopamine → S- norlaudanosoline | Coptis japonica, Papaver somniferum, Papaver bracteatum, Thalictum flavum, Corydalis saxicola | BAF45337.1, AB267399.2, ACI45396.1, ACO90258.1, ACO90247.1, AEB71889.1 |
| Norcoclaurine 6-O-methyltransferase | 6OMT | Norcoclaurine → coclaurine Norlaudanosoline → 3'hydroxycoclaurine EC 2.1.1.128 | P. somniferum T. flavum Coptis japonica* | AY268894 AY610507 D29811 |

TABLE 3-continued

List of enzymes

| Enzyme | Abbrev | Catalyzed Reactions | Source organisms | Genbank # |
|---|---|---|---|---|
| Coclaurine-N-methyltransferase | CNMT | Coclaurine → N-methylcoclaurine<br>3'hydroxycoclaurine → 3'-hydroxy-N-methylcoclaurine<br>EC 2.1.1.140 | P. somniferum<br>T. flavum<br>Coptis japonica* | AY217336<br>AY610508<br>AB061863 |
| 4'-O-methyltransferase | 4OMT | 3'-hydroxy-N-methylcoclaurine → Reticuline<br>EC 2.1.1.116 | P. somniferum<br>T. flavum<br>Coptis japonica* | AY217333,<br>AY217334<br>AY610510<br>D29812 |
| Cytochrome P450 80B1 | CYP80B1 | N-methylcoclaurine → 3'-hydroxy-N-methylcoclaurine<br>(EC 1.14.13.71) | P. somniferum,<br>E. californica,<br>T. flavum | AAF61400.1<br>AAC39453.1<br>AAU20767.1 |
| GTP cyclohydrolase | FOL2 | GTP → dihydroneopterin triphosphate<br>(EC 3.5.4.16) | Saccharomyces cerevisiae, Homo sapiens,<br>Mus musculus | CAA97297.1,<br>NP_001019195.1,<br>NP_032128.1 |
| 6-pyruvoyl tetrahydrobiopterin (PTP) synthase | PTPS | dihydroneopterin triphosphate → PTP<br>(EC 4.2.3.12) | Rattus norvegicus,<br>Homo sapiens,<br>Mus musculus | AAH59140.1,<br>BAA04224.1,<br>AAH29013.1 |
| Sepiapterin reductase | SepR | PTP→ BH4 (EC 1.1.1.153) | Rattus norvegicus,<br>Homo sapiens,<br>Mus musculus | NP_062054.1,<br>NP_003115.1,<br>NP_035597.2 |
| 4a-hydroxytetrahydrobiopterin (pterin-4α-carbinolamine) dehydratase | PCD | 4a-hydroxytetrahydrobiopterin → H2O + quinoid dihydropteridine (EC 4.2.1.96) | Rattus norvegicus,<br>Homo sapiens,<br>Mus musculus | NP_001007602.1,<br>AAB25581.1,<br>NP_079549.1 |
| Quinoid dihydropteridine reductase | QDHPR | quinoid dihydropteridine → BH4 (EC 1.5.1.34) | Rattus norvegicus,<br>Homo sapiens,<br>Mus musculus | AAH72536.1,<br>NP_000311.2,<br>AAH02107.1 |
| Dihydrofolate reductase | DHFR | 7,8-Dihydrobiopterin → 5,6,7,8-Tetrahydrobiopterin (BH4)<br>EC 1.5.1.3 | Rattus norvegicus,<br>Homo sapiens | AF318150.1 |
| 1-benzylisoquinoline alkaloid epimerase (cytochrome P450 82Y2-codeinone reductase; dehydroreticuline synthase-dehydroreticuline reductase) | DRS-DRR (CYP-COR) | (S)-reticuline –> (R)-reticuline<br>(S)-1-benzylisoquinoline–>(R)-1-benzylisoquinoline<br>EC 1.5.1.27 | Papaver bracteatum,<br>Papaver somniferum,<br>Papaver setigerum,<br>Chelidonium majus | P0DKI7.1,<br>AKO60175.1,<br>AKO60180.1,<br>AKO60179.1,<br>AKO60175.1 |
| (R)-reticuline, NADPH: oxygen oxidoreductase (C-C phenol-coupling), also known as salutaridine synthase | SalSyn | (R)-reticuline + NADPH + H+ + O2 → salutaridine + NADP+ + 2 H2O<br>EC 1.14.21.4 | Papaver somniferum,<br>Papaver spp<br>Chelidonium majus | EF451150<br>(Ref PMID 22424601) |
| salutaridinol: NADP + 7-oxidoreductase, also known as salutaridine reductase | SalR | salutaridinol + NADP+ ↔ salutaridine + NADPH + H+<br>EC 1.1.1.248 | Papaver somniferum,<br>Papaver bracteatum,<br>Papaver spp<br>Chelidonium majus | DQ316261,<br>EF184229<br>(Ref PMID 22424601) |
| acetyl-CoA: salutaridinol 7-O-acetyltransferase | SalAT | acetyl-CoA + salutaridinol → CoA + 7-O-acetylsalutaridinol<br>EC 2.3.1.150 | Papaver somniferum,<br>Papaver bracteatum,<br>Papaver orientale,<br>Papaver spp | AF339913,<br>FJ200355,<br>FJ200358,<br>FJ200356,<br>JQ659008 |
| thebaine synthase | TS | 7-O-acetylsalutaridinol → thebaine + acetate | Papaver somniferum,<br>Papaver bracteatum,<br>Papaver orientale,<br>Papaver spp | AWQ63979,<br>AWQ63980 |
| Thebaine 6-O demethylase | T6ODM | thebaine → neopinone EC 1.14.11.31 | Papaver somniferium,<br>Papaver spp. | GQ500139.1 |
| Codeinone reductase | COR | codeinone→ codeine EC 1.1.1.247,<br>neopinone→ neopine | Papaver somniferium,<br>Papaver spp. | AF108432.1<br>AF108433.1<br>AF108434.1<br>AF108435.1 |
| Codeine O-demethylase | CODM | codeine→ morphine EC 1.14.11.32,<br>neopine→ neomorphine | Papaver somniferium,<br>Papaver spp. | GQ500141.1 |
| Morphine dehydrogenase | morA | morphine → morphinone EC 1.1.1.218,<br>codeinone → codeine EC 1.1.1.247 | Pseudomonas putida | M94775.1 |
| Morphinone reductase | morB | codeinone → hydrocodone<br>morphinone → hydromorphone EC 1.3.1.- | Pseudomonas putida | U37350.1 |
| NADPH: hemoprotein oxidoreductase, also known as cytochrome P450 reductase | ATR1, CPR | NADPH + H+ + n oxidized hemoprotein → NADP+ +<br>n reduced hemoprotein EC 1.6.2.4 | Arabidopsis thaliana, E. californica, P. somniferum, H. sapiens, S. cerevisiae, P. bracteatum, Papaver spp., all plants | NM118585,<br>CAB58576.1,<br>CAB58575.1,<br>AAC05021.1,<br>AAC05022.1<br>many others<br>(Ref PMID 19931102) |

TABLE 3-continued

List of enzymes

| Enzyme | Abbrev | Catalyzed Reactions | Source organisms | Genbank # |
|---|---|---|---|---|
| Cytochrome P450, family 2, subfamily D, polypeptide 6 | CYP2D6 | Promiscuous oxidase, can perform (R)-reticuline + NADPH + H+ + O2 → salutaridine + NADP+ + 2 H2O among other reactions<br>EC 1.14.14.1 | *Homo sapiens* | BC067432 |
| S-adenosyl-L-methionine: (S)-scoulerine 9-O-methyltransferase | S9OMT | S-adenosyl-L-methionine + (S)-scoulerine → S-adenosyl-L-homocysteine + (S)-tetrahydrocolumbamine<br>EC 2.1.1.117 | *Thalictrum flavum* subsp. *glaucum*, *Papaver somniferum*, *Coptis japonica*, *Coptis chinensis*, *Thalictrum* spp, *Coptis* spp, *Papaver* spp | AY610512, D29809, EU980450, JN185323 |
| Tetrahydroprotoberberine-N-methyltransferase | TNMT | Stylopine → cis-N-methylstylopine<br>EC 2.1.1.122<br>Canadine → N-methylcanadine | *P. somniferum*<br>*E. californica*<br>*P. bracteatum*<br>*A. mexicana* | DQ028579<br>EU882977<br>EU882994<br>HQ116698 |
| Cheilanthifoline synthase | CFS | Cheilanthifoline → stylopine<br>EC 1.14.21.1 | *P. somniferum*<br>*E. californica*<br>*P. bracteatum*<br>*A. mexicana* | GU325749<br>AB434654<br>EF451152 |
| Stylopine synthase | STS | Stylopine → cis-N-methylstylopine<br>EC 2.1.1.122 | *P. somniferum*<br>*E. californica*<br>*P. bracteatum*<br>*A. mexicana* | GU325750<br>AB126257<br>EF451151 |
| Cis-N-methylstylopine 14-hydroxylase | MSH | Cis-N-methylstylopine → protopine<br>EC 1.14.13.37 | *P. somniferum*<br>*E. californica*<br>*P. bracteatum*<br>*A. mexicana* | KC154003 |
| Protopine-6-hydroxylase | P6H | Protopine → 6-hydroxyprotopine<br>EC 1.14.13.55 | *E. californica*<br>*P. somniferum*<br>*P. bracteatum*<br>*A. mexicana* | AB598834<br>AGC92397 |
| Dihydrobenzophenanthridine oxidase | DBOX | Dihydrosanguinarine → sanguinarine<br>EC 1.5.3.12 | *P. somniferum*<br>*E. californica*<br>*P. bracteatum*<br>*A. mexicana* | AGL44336, AGL44335, AGL44334 |
| (S)-tetrahydroprotoberberine oxidase | STOX | (S)-tetrahydroberberine + 2 O$_2$ → berberine + 2 H$_2$O$_2$<br>EC 1.3.3.8 | *Berberis wilsonae*, *Coptis japonica*, *Berberis* spp, *Coptis* spp | HQ116697, AB564543 |
| (S)-tetrahydrocolumbamine, NADPH: oxygen oxidoreductase (methylenedioxy-bridge-forming), also known as (S)-canadine synthase | CAS | (S)-tetrahydrocolumbamine + NADPH + H+ + O2 → (S)-canadine + NADP+ + 2 H2O<br>EC 1.14.21.5 | *Thalictrum flavum* subsp. *glaucum*, *Coptis japonica*, *Thalictrum* spp, *Coptis* spp | AY610513, AB026122, AB374407, AB374408 |
| (S)-reticuline: oxygen oxidoreductase (methylene-bridge-forming), also known as berberine bridge enzyme | BBE | (S)-reticuline + O2 → (S)-scoulerine + H2O2<br>EC 1.21.3.3 | *Papaver somniferum*, *Argemone mexicana*, *Eschscholzia californica*, *Berberis stolonifera*, *Thalictrum flavum* subsp. *glaucum*, *Coptis japonica*, *Papaver* spp, *Eschscholzia* spp, *Berberis* spp, *Thalictrum* spp | AF025430, EU881889, EU881890, S65550, AF005655, AF049347, AY610511, AB747097 |
| Berbamunine synthase | CYP80A1 | (S)-N-methylcoclaurine + (R)-N-methylcoclaurine –> berbamunine<br>EC 1.14.21.3<br>1-benzylisoquinoline alkaloid + 1-benzylisoquinoline alkaloid –> bis-benzylisoquinoline alkaloid | *Berberis stolonifera*, *Capsicum chinense*, *Quercus suber* | AAC48987, PHU28278, POF05239 |
| Protopine O-dealkylase | PODA | O,O-demethylenation of canadine, stylopine and berberine | *P. somniferum*, *Papaver* spp. | GQ500140.1 |
| Reticuline N-methyltransferase | RNMT | reticuline→tembetarine | *Papaver somniferum*, *Papaver* spp. | KX369612.1 |
| Papaverine 7-O-demethylase | P7OMT | papaverine→pacodine | *Papaver somniferum*, *Papaver* spp. | KT159979.1 |
| 3-O-demethylase | 3ODM | oxycodone→oxymorphone<br>hydrocodone→hydromorphone<br>dihydrocodeine→dihydromorphine<br>14-hydroxycodeine→14-hydroxymorphine<br>codeinone→morphinone<br>14-hydroxycodeinone→14-hydroxymorphinone | *Papaver somniferum*, *Papaver bracteatum*, *Papaver rhoeas*, *Papaver* spp. | |

TABLE 3-continued

List of enzymes

| Enzyme | Abbrev | Catalyzed Reactions | Source organisms | Genbank # |
|---|---|---|---|---|
| N-demethylase (in some cases the NDM activity is encoded in BM3 or an engineered variant of BM3) | NDM | Codeine→Norcodeine<br>Morphine→Normorphine<br>Oxycodone→Noroxycodone<br>Oxymorphone→Noroxymorphone<br>Thebaine→Northebaine<br>Oripavine→Nororipavine<br>Hydrocodone→Norhydrocodone<br>Hydromorphone→Norhydromorphone<br>Dihydrocodeine→Nordihydrocodeine<br>Dihydromorphine→Nordihydromorphine<br>14-hydroxycodeine→Nor-14-hydroxycodeine<br>14-hydroxymorphine→Nor-14-hydroxymorphine<br>Codeinone→Norcodeinone<br>Morphinone→Normorphinone<br>14-hydroxycodeinone→Nor-14-hydroxycodeinone<br>14-hydroxymorphinone→Nor-14-hydroxymorphinone | *Bacillus megaterium, Homo sapiens, Papaver somniferum, Papaver* spp., *Chelidonium majus, Stylophorum diphyllum, Nigella sativa, Hydrastis canadensis, Glaucium flavum, Eschscholzia californica, Menispermum canadense, Papaver bracteatum* | |
| N-methyltransferase | NMT | Norcodeine→codeine<br>Normorphine→morphine<br>Noroxycodone→oxycodone<br>Noroxymorphone→noroxymorphone<br>Northebaine→thebaine<br>Nororipavine→oripavine<br>Norhydrocodone→hydrocodone<br>Norhydromorphone→ Hydromorphone<br>Nordihydrocodeine→ Dihydrocodeine<br>Nordihydromorphine→ Dihydromorphine<br>Nor-14-hydroxycodeine→ 14-hydroxycodeine<br>Nor-14-hydroxymorphine→ 14-hydroxymorphine<br>Norcodeineone→ Codeineone<br>Normorphinone→ Morphinone<br>Nor-14-hydroxy-codeinone→ 14-hydroxycodeinone<br>Nor-14-hydroxy-morphinone→ 14-hydroxymorphinone | *Papaver* spp., *Chelidonium majus, Thalictrum flavum, Coptis japonica, Papaver somniferum, Eschscholzia californica, Papaver bracteatum, Argenome mexicana, Glaucium flavum, Sanguinaria canadensis, Corydalis chelanthifolia, Nigella sativa, Jeffersonia diphylla, Berberis thunbergii, Mahonia aguifolium, Menispermum canadense, Tinospora cordifolia, Cissampelos mucronata, Cocculus trilobus* | |
| N-allyltransferase | NAT | Norcodeine→N-allyl-norcodeine<br>Normorphine→N-allyl-normorphine<br>Noroxycodone→N-allyl-noroxycodone<br>Noroxymorphone→N-allyl-nornoroxymorphone<br>Northebaine→N-allyl-northebaine<br>Nororipavine→N-allyl-nororipavine<br>Norhydrocodone→N-allyl-norhydrocodone<br>Norhydromorphone→ N-allyl-norhydromorphone<br>Nordihydrocodeine-> N-allyl-nordihydrocodeine<br>Nordihydromorphine→ N-allyl-nordihydromorphine<br>Nor-14-hydroxycodeine→ N-allyl-nor-14-hydroxycodeine<br>Nor-14-hydroxymorphine→ N-allyl-nor-14-hydroxymorphine<br>Norcodeineone→ N-allyl-norcodeineone<br>Normorphinone→ N-allyl-normorphinone<br>Nor-14-hydroxy-codeinone→ N-allyl-nor-14-hydroxycodeinone<br>Nor-14-hydroxy-morphinone→ N-allyl-nor-14-hydroxymorphinone | *Papaver* spp., *Chelidonium majus, Thalictrum flavum, Coptis japonica, Papaver somniferum, Eschscholzia californica, Papaver bracteatum, Argenome mexicana, Glaucium flavum, Sanguinaria canadensis, Corydalis chelanthifolia, Nigella sativa, Jeffersonia diphylla, Berberis thunbergii, Mahonia aguifolium, Menispermum canadense, Tinospora cordifolia, Cissampelos mucronata, Cocculus trilobus* | |
| N-cyclopropylmethyltransferase | CPMT | Norcodeine→N(cyclopropylmethyl)norcodeine<br>Normorphine→N(cyclopropylmethyl)normorphine<br>Noroxycodone→N(cyclopropylmethyl)noroxycodone<br>Noroxymorphone→N(cyclopropylmethyl)nornoroxymorphone<br>Northebaine→N(cyclopropylmethyl)northebaine<br>Nororipavine→N(cyclopropylmethyl)nororipavine<br>Norhydrocodone→N(cyclopropylmethyl)norhydrocodone | *Papaver* spp., *Chelidonium majus, Thalictrum flavum, Coptis japonica, Papaver somniferum, Eschscholzia californica, Papaver bracteatum, Argenome mexicana, Glaucium flavum, Sanguinaria canadensis, Corydalis chelanthifolia, Nigella sativa, Jeffersonia diphylla,* | |

TABLE 3-continued

List of enzymes

| Enzyme | Abbrev | Catalyzed Reactions | Source organisms | Genbank # |
|--------|--------|---------------------|------------------|-----------|
| | | Norhydromorphone→ N(cyclopropylmethyl)norhydromorphone Nordihydrocodeine→ N(cyclopropylmethyl)nordihydrocodeine Nordihydromorphine-> N(cyclopropylmethyl)nordihydromorphine Nor-14-hydroxycodeine→ N(cyclopropylmethyl)nor-14-hydroxycodeine Nor-14-hydroxymorphine→ N(cyclopropylmethyl)nor-14-hydroxymorphine Norcodeineone→ N(cyclopropylmethyl)norcodeineone Normorphinone→ N(cyclopropylmethyl)normorphinone Nor-14-hydroxy-codeinone→ N(cyclopropylmethyl)nor-14-hydroxycodeinone Nor-14-hydroxy-morphinone→ N(cyclopropylmethyl)nor-14-hydroxymorphinone | *Berberis thunbergii, Mahonia aguifolium, Menispermum canadense, Tinospora cordifolia, Cissampelos mucronata, Cocculus trilobus* | |

TABLE 4

O-demethylase candidate enzymes

| Name | Sequence | SEQ ID NO: |
|------|----------|------------|
| T6ODM | MEKAKLMKLGNGMEIPSVQELAKLTLAEIPSRYVCANENLLLPMGASVINDHETIPVIDIENLLSPEPII GKLELD RLHFACKEWGFFQVVNHGVDASLVDSVKSEIQGFFNLSMDEKTKYEQEDGDVEGFGQGFIESEDQTL DWADIFMMFTLPLHLRKPHLFSKLPVPLRETIESYSSEMKKLSMVLFNKMEKALQVQAAEIKGMSEV FIDGTQAMRMNYYPPCPQPNLAIGLTSHSDFGGLTILLQINEVEGLQIKREGTWISVKPLPNAFVVNVG DILEIMTNGIYHSVDHRAVVNSTNERLSIATFHDPSLESVIGPISSLITPETPALFKSGSTYGDLVEECKT RKLDGKSFLDSMRI | 62 |
| CODM | METPILIKLGNGLSIPSVQELAKLTLAEIPSRYTCTGESPLNNIGASVTDDETVPVIDLQNLLSPEPVVGK LELDKLHSACKEWGFFQLVNHGVDALLMDNIKSEIKGFFNLPMNEKTKYGQQDGDFEGFGQPYIESE DQRLDWTEVFSMLSLPLHLRKPHLFPELPLPFRETLESYLSKMKKLSTVVFEMLEKSLQLVEIKGMTD LFEDGLQTMRMNYYPPCPRPELVLGLTSHSDFSGLTILLQLNEVEGLQIRKEERWISIKPLPDAFIVNV GDILEIMTNGIYRSVEHRAVVNSTKERLSIATFHDSKLESEIGPISSLVTPETPALFKRGRYEDILKENLS RKLDGKSFLDYMRM | 63 |
| PsP7ODM | MEKAKLMKLGNGLSIPSVQELAELTFAEVPSRYVCTNDENLLLMTMGASEIDDETVPVIDLQNLLSPE PAIGKSELDWLHYSCKEWGFFQLVNHGVDALLVDHVKSEIHSFFNLPLNEKTKYGQRDGDVEGFGQA FLVSENQKLDWADMFFINTLPLHLRKPHLFPNLPLPLRETIESYSSEMKKLSMVLFEMMGKAIEVIDI KEAITEMPEDGMQSMRMNYYPPCPQPERVIGITPHSDFDGLTILLQLNEVEGLQIRKEDKWISIKPLPD AFIVNVGDIWEIMTNGVHRSVDHRGVINSTKERLSIATFHSPKLELEIGPISSLIRPETPAVFKSAGRFE DLLKEGLSRKLDGKSFLDCMRM | 64 |
| PsoDIOX1 | MEKAKLMKLGNGMEIPSVQELAKLTLAEIPSRYVCANENLLLPMGASVINDHETIPVIDIENLLSPEPII GKLELDRLHFACKEWGFFQVVNHGVDASLVDSVKSEIQGFFNLSMDEKTKYEQEDGDVEGFGQGFIE SEDQTLDWADIFMMFTLPLHLRKPHLFSKLPVPLRETIESYSSEMKKLSMVLFNKMEKALQVQAAEI KGMSEVFIDGTQAMRMNYYPPCPQPNLAIGLTSHSDFGGLTILLQINEVEGLQIKREGTWISVKPLPNA FVVNVGDILEIMTNGIYHSVD | 65 |
| PsoDIOX2 | METAKLMKLGNGMSIPSVQELAKLTLAEIPSRYICTVENLQLPVGASVIDDHETVPVIDIENLISSEPVT EKLELDRLHSACKEWGFFQVVNHGVDTSLVDNVKSDIQGFFNLSMNEKIKYGQKDGDVEGFGQAFVA SEDQTLDWADIFMILTLPLHLRKPHLFSKLPLPLRETIESYSSEMKKLSMVLFEKMEKALQVQAVEIKE ISEVFKDMTQVMRMNYYPPCPQPELAIGLTPHSDFGGLTILLQLNEVEGLQIKNEGRWISVKPLPNAF VVNVGDVLEIMTNGMYRSVDHRAVVNSTKERLSIATFHDPNLESEIGPISSLITPNTPALFRSGSTYGEL VEEFHSRKLDGKSFLDSMRM | 66 |
| PbrDIOX2 | METPKSIKLGGSLLVPSVQELAQQSFAEVPARYVRDDLEPLTDLSGVSMIDQTIPVIDLQKLQSPVPIIR ELESELHSACKEWGFFQVVNHGVDILLVEKTKSEIKDFFNLPMDEKKKFWQEEGDIQGFGQAFVQS EDQKLDWADIFLMVTLPRHTRNPRLFPKLPLPLRNTMDSYSSKLSKLASTLIEMMGKALHMETSVLA ELFEDGRQTMRINYYPPCPQPKDVIGLTPHSDGGGLTILLQLNEVDGLQIRKEKIWIPIKPLPNAFVVNI GNILEIMTNGIYRSVEHRATIHSTKERLSVAAFHNPKVGVEIGPIVSMITPESPALFRTIEYDDYGKKYFS RKLDGKSSLDFMRIGEGDEENKAT | 67 |

TABLE 4-continued

O-demethylase candidate enzymes

| Name | Sequence | SEQ ID NO: |
|---|---|---|
| PbrDIOX3 | METPKLIKLGGSLLVPSVLELTKQSPAEVPARYIRNDLEPMTDLSSASLTDQTIPVIDLQNLLSPEPELE<br>LEKLHSGCKEWGFFQVMNHGVDILLVEKVKSEIQGFFNLPIDEKNKFWQEEGDLEGYGKAFVHSEDE<br>KLDWADMFFILTQPQYMRKPRVFPKLPLRLRETIESYSLELSKLGLTLLDLMGKALQIETGVMSELFE<br>DGRQTMRMNYYPPCPQPEHVIGLTPHSDGGALTILLQLNQVDGLQIRKEEIWVPIKPLPNAFVVNIGDI<br>LEIMSNGVYRSVEHRATINSSKERLSVAIFQSPKHGTEIGPILSMITPEAPALFKTIPYEDYLRKFFSRKL<br>GGKSFVDSMRIGESDEDNNTA | 68 |
| PbrDIOX4 | METQKQENFGASLSVPNVQELAKQSPEQVPDRYIRSDQDSSTNISCPSMTDQIPVIDLQSLLSPDPIIGE<br>LELERLHSACKEWGFFQVMNHGVDNLLVEKVKSEIQGFFNLPMDEKKKFWQEEGDFEGFGQAFVFSE<br>DQKLDWGDVFFILTQPQHMRKPRLFPKLPLPFRKTIESYSLETNKLSMTLLELMEKALKIETGVMTEL<br>FEGGIQRMRMTYYPPCPQPKHVIGLTPHSDPDALTILLQLNEVDGLQIRKEKIWVPIKPLSNAFVVNIG<br>DILEIMSNGIYRSVEHRATVNSTKERLSVATFHSPRKDTEIGPILITPETPALFRTSGFEDYFRKFFAHK<br>LNGKSFLSSIRIGETDEGNNAT | 69 |
| PbrDIOX5 | MEAPKLIMLGGSLFVPSVQELAKQSLAEVPVRYVRDDQDTLGNNINITPMSMIDQSIPVIDLEKLLSPE<br>PIVGELELERLHSACKEWGFFQVVNHGVDSLLVEKVKSEIEGFFKLPMDEKTKFWQEEGDIEGFGQVF<br>VHSQDQKLDWGDMFLMQTLPRHTRKPRLFPNLPLPLRQTIESYSSELSKLVLTLVDLMGKALQMESG<br>VLTELFENGIQRMRMNYYPPCPQPEQVIGLTPHSDVGGLTILLQLNEVDGLQIKKDKVWVPIKPLANA<br>FVVNVGDALEIMSNGIYRSVEHRATINSTKERLSIATFHNPRADREIGPIPSMISPETPALFKTTGYEEY<br>FKKFFSRKLEGKSFLDSLRIREGDEHCGRLDVKGPCN | 70 |
| PbrDIOX6 | MEIPNPIKIGSSLLVPSVQELAKQSFAEVPARYIRNDVDPLITKLSDVSLIDQTVPVIDLQKLLSPEPIV<br>GELELERLHSACKEWGFFQVMNHGVDNLLVEKVKSEIQGFFNLPMEEKKKFWQEEGDFEGFGQMFV<br>QSEE<br>QKLDWGDMFFILTQPQHMRKPRLFSKLPLPLRETIESYSLELIKLGLTIIKLMEKALQIDAGVMAELFE<br>D<br>GIHTMRMNYYPPCPQPEHVIGLTPHSDGGGLTILLQLNEVDGLQIRRENIWVPIKPLPNAFVVNIGDIL<br>E<br>ILSNGIYRSVEHRSTVNATKERLSVATFQNPKQESVIGPNMITPERPALFRKIVYKDYMKKLFSRKLDG<br>K<br>SFLDSLRIGEGDERP | 71 |
| PbrDIOX8 | METLKTVKPGGSLFIPNGQELAKQSLEEVYVGNDQDTMLLIGQTIPVIDLQKLLSPEPITGDMELDKLH<br>S<br>ACKEWGFFQVVNHGVDILLVEKVKSEVHDFFNIPMDEKKPFWQEEGDLEGFGQVFITSEDQQLDWG<br>DMFF<br>MVTLPKHMRKPRLFLKLPLPLRETIESYSLKLSKLGVTLVELMGKALQMEDRIMSELFDDGRQTMRM<br>NYY<br>PPCPQPEQVIGLTPHSDPGGLTILLELNEVNGLIRKENIWVPIIPLPNAFIVNIGDILEIMSNGIYHSVE<br>HRATINSTKERLSVAMFNSPKVDTEIGPIHSMITPETPALFRTIGYDEYLKIFFSRKLDGKSLLESMKI | 72 |
| PbrDIOX10 | MEAPKLIMLGGSLFVPSVQELAKQSLAEVPVRYVRDDQDTLGNNINITPMSMIDQSIPVIDLEKLLSPE<br>P<br>IVGELELERLHSACKEWGFFQVVNHGVDSLLVEKVKSEIEGFFELPVDEKKKFWQEEGDIEGFGQIFV<br>HS<br>EDQKLDWADMFYMLTLPPNMRKPRLFPNLPLPLRQTIDSYSSELSKLVLTLVDLMGKALQMESGVLT<br>ELF<br>ENGIQRMRMNYYPPCPQPEQVIGLTPHSDVGGLTILLQLNEVDGLQIKKDKIWVPIKPLRNAFVVNVG<br>DA<br>LEIMSNGIYRSVEHRATINSTKERLSIATFHNPRADREIGPIPSMISPETPALFKTTGYEEYFKKFFSRK<br>LEGKSFLDSLRIGEGDEHCGRLXVKGXCN | 73 |
| PbrDIOX11 | METPKLMKLGGSLFVPSVQELAKQSLAEVPARYVRDDRDMVGNIINVTPMSMIDQSIPVIDLEKLLSP<br>DL<br>IVGELELERLHSACKEWGFFQVVNHGVDSLLVEKVKSEIEGFFELPMDEKKKFWQEEGDAEGFAQFF<br>VQS<br>EDQKLDYSGDMFFMLNLPQHMRKPRLFLKLPLPLRETIESYSLKLSKLGVTLVELMGKALQMEDRIM<br>SEL<br>FDDGRQTMRMNYYPPCPQPEQVIGLTPHSDPGGLTILLELNEVNGLIRKENIWVPIIPLPNAFIVNIGDI<br>LEIMSNGIYHSVEHRATINSTKERLSVAMFNSPKVDTEIGPIHSMITPETPALFRTIGYDEYLKIFFSRK<br>LDGKSLLESMKI | 74 |
| PbrDIOX13 | METPKLRDFGSFLPVPSVQELAKQVLTEIPPRYIRTDLEALNKLSCASNTDQTVPIIDMQCLLSAEPEM<br>E<br>LEKLHSACKEWGFFRVVNHGVDNLESVKSEIESFLNLPVNAKNKYGQKQGDDQGFGSRFVLSEEQKL<br>DWG<br>DFFYMVTRPLYLRKPHLFPELPLPLRETIESYSSEVSKLAMALFEMMGKALKIETGVMTEIFEGGMQA<br>MR<br>MNYYPPCPRPDLVIGLNAHSDFGGLTILLQLNEVEGLEIRNKGEWVSVKPLANAFVVNVGDVMEILTN<br>GI<br>YHSVEHRATINSSKERLSVATFHYPKLETGIGPLPCMITPKTPALFGRIERYELLLRKYYARKLNGKSTL<br>DCMRIGNGFEDDNTA | 75 |

TABLE 4-continued

O-demethylase candidate enzymes

| Name | Sequence | SEQ ID NO: |
|---|---|---|
| PbrDIOX18 | MEAPKLIMLGGSLFVPSVQELAKQSLAEVPARYVRDDQDTLGNNINITPMSMIDQSIPVIDLEKLLSPE<br>P<br>IVGELELERLHSACKEWGFFQVVNHGVDSLLVEKVKSEIEGFFELPVDEKKKFWQEEGDIEGFGQIFV<br>HS<br>EDQKLDWADMFYMLTLPPNMRKPRLFPNLPLPLRQTIDSYSSELSKLVLTLVDLMGKALQMESGVLT<br>ELF<br>ENGIQRMRMNYYPPCPQPEQVIGLTPHSEVGGLTILLQLNEVDGLQIRKEKIWVPIKPLSNAFIVNIGDI<br>LEIMSNGIYRSVEHRATVNSTKERLSVATFHSPRKDTEIGPILITPETPALFRTSGFEDYFRKFFAHKLN<br>GKSFLSSIRIGETDEGNNAT | 76 |
| PbrDIOX19 | MSMIDQSIPVIDLEKLLSPEPIVGELELERLHSACKEWGFFQVVNHGVDSLLVEKVKSEIEGFFELPVDE<br>KKKFWQEEGDIEGFGQIFVHSEDQKLDWADMFYMLTLPPNMRKPRLFPNLPLPLRQTIDSYSSELSK<br>LVL<br>TLVDLMGKALQMESGVLTELFENGIQRMRMNYYPPCPQPEQVIGLTPHSDVGGLTILLQLNEVDGLQI<br>RK<br>EKIWVPIKPLSNAFIVNIGDILEIMSNGIYHSVEHRATINSTKERLSVAMFNSPKVDTEIGPIHSMITPE<br>TPALFRTIGYDEYLKIFFSRKLDGKSLLESMKI | 77 |
| PbrDIOX21 | METPKLVKSSGSSLFLSTSVQELAKQSLPEVPARYIRTNLEPLSNVSGDSQSVPVIDLQKLLSSEPIIGE<br>LELDKLHSACKEWGFFQVVNHGVDNLVMEKIKTEIQGFFNLSLDEKQKFWKKEGDAEGFGQNFIESE<br>DQK<br>LDWGDTFGMFTLPIHMRNPRLFPELPLPLRETIESYSLDVRKLALALIGLMEKALKIKTSAMSELFEDG<br>G<br>QAMRMNYYPPCPQPEHVIGLTPHSDAGGLTILLQLNEVDGLQIKKDKIWVPIKPLPNAFVVNIGDILEI<br>M<br>TNGIYRSVEHRATINSSKERLSVAAFHSPKGDTLIGPMVSLITPETPALFRTIGYQDYMKKFMSRKLDG<br>K<br>SLVNSMRIGEGDEDK | 78 |
| PbrDIOX-<br>ZSNV-<br>2004018 | METPTLMKLGNGLSVPSVQELAKATLAEIPSRYICTDENLLTMGASTTDNETVPVIDLQNLLSPEPVIG<br>MLELDRLHSACKEWGFFQLVNHGVDALLVDNEVQGFFNLPMDEKTKYGQKDGDDEGFGQFFVISED<br>QKLDWADVFYMSTLPLHSRKPHLFPELPLPLRETMESYSSEMKKLSMVLFDMMGKALQVVEIKGITE<br>LFEDGAQQIRMNYYPPCPQPELVFGLTSHSDFDGLTILLQLGEVEGLQIKKEERWISIKPLPDAFIVNVG<br>DILEIMTNGIYRSVDHRAVVNSIKERLTIATFHDPRLEAEIGPISSLITPETPALFKRGVFEDLLKEMFLR<br>KLDGKSFLDCMRM | 79 |
| PrhDIOX-<br>MVTX-<br>2001522 | GNGLSVPSVQELAKQTLAEIPSRYICTDENPLITGASVVDDETVPVINLQNLLSPEPVIGKLELDKLHSA<br>CKEWGFFQVVNHGVDSLVDSVKSEIEGFFNLPANEKLKYGQKDGDVEGFGQHFVVSEDQKLDWAD<br>VFYMTLPVRLRKPHLFPELPLPLRDTLDSYSSELNKLSMVLLEMMEKALKLVECKGITDFFEDGFQQ<br>MRMNYYPPCPRPELVTGLTSHSDFGGLTILLQLNDVEGLQIKKEERWISIKPLPNAFIVNIGDVLEIMS<br>NGIYRSVDHRAVINSTKVRMSVATFHDPRLEAVIGPISSLITPETPALFKRGVFEDLLKEMFLRKLDGK<br>SFLDCMRI | 80 |
| PseDIOX-<br>JSVC-2005842 | LMKLANGMSVPIVQELAKLTVGEIPSRYICTDGNLLTMGASVIDYETVPVIDLQNLQSREPVIEKLELD<br>RLHSACKEWGFFQLLNHGVDASLMDNVRSEIRGFFNLPISDKMKYGQKDGDEEGFGQHFIVSEDQKL<br>DWDAFMMFTLPLHSRNPRLTPEFPQPLRETVESYSSEMKKLSVLLFELMEKALQVKGITEMFEDGL<br>QSIRMNYYPPCPRPELAIGLTSHSDFDGLTILLQLNEVEGLQIKKEERWISIKPLPNAFIVNGDVLEVM<br>TNGIYRSVDHRAVVNSTKERLSIATFHDPELESEIGPIASLITPETPALFKRGRFKDLLKENLSTKLDGK<br>SFLDCIRM | 81 |
| CYP2D6 | MGLEALVPLAVIVAIFLLLVDLMHRRQRWAARYSPGPLPLPGLGNLLHVDFQNTPYCFDQLRRRFGD<br>VFSLQLAWTPVVVLNGLAAVREALVTHGEDTADRPPVPITQILGFGPRSQGVFLARYGPAWREQRRF<br>SVSTLRNLGLGKKSLEQWVTEEAACLCAAFANHSGRPFRPNGLLDKAVSNVIASLTCGRRFEYDDPRF<br>LRLLDLAQEGLKEESGFLREVLNAVPVLLHIPALAGKVLRFQKAFLTQLDELLTEHRMTWDPAQPPR<br>DLTEAFLAEMEKAKGNPESSFNDENLRIVVADLFSAGMVTTSTTLAWGLLLMILHPDVQRRVQQEID<br>DVIGQVRRPEMGDQAHMPYTTAVIHEVQRFGDIVPLGVTHMTSRDIEVQGFRIPKGTTLITNLSSVLK<br>DEAVWEKPFRFHPEHFLDAQGHFVKPEAFLPFSAGRRACLGEPLARMELFLFFTSLLQHFSFSVPTGQ<br>PRPSHHGVFAFLVTPSPYELCAVPR | 82 |

TABLE 5

N-demethylase candidate enzymes

| Name | Sequence | SEQ ID NO: |
|---|---|---|
| BM3 | MTIKEMPQPKTFGELKNLPLLNTDKPVQALMKIADELGEIFKFEAPGRVTRYLSSQRLIKEAC<br>DESRFDKNLSQAAKFARDFAGDGLVTSWTHEKNWKKAHNILLPSFSQQAMKGYHAMMVD<br>IAVQLVQKWERLNADEHIEVSEDMTRLTLDTIGLCGFNYRFNSFYRDQPHPFIISMVRAADE<br>VMNKLQRANPDDPAYDENKRQFQEDIKVMNDLVDKIIADRKARGEQSDDLLTQMLNGKDP<br>ETGEPLDDGNIRYQIITFLIAGHETTSGLLSFALYFLVKNPHVLQKVAEEAARVLVDPVPSYKQ<br>VKQLKYVGMVLNEALRLWPTAPAFSLYAKEDTVLGGEYPLEKGDEVMVLIPQLHRDKTVW<br>GDDVEEFRPERFENPSAIPQHAFKPFGNGQRACIGQQFALHEATLVLGMMLKHFDFEDHTN<br>YELDIKETLTLKPKGFVVKAKSKKIPLGGIPSPSTEQSAKKVRKKAENAHNTPLLVLYGSNMG | 83 |

TABLE 5-continued

N-demethylase candidate enzymes

| Name | Sequence | SEQ ID NO: |
|---|---|---|
| | TAEGTARDLADIAMSKGFAPQVATLDSHAGNLPREGAVLIVTASYNGHPPDNAKQFVDWLD<br>QASADEVKGVRYSVFGCGDKNWATTYQKVPAFIDETLAAKGAENIADRGEADASDDFEGTY<br>EEWREHMWSDVAAYFNLDIENSEDNKSTLSLQFVDSAADMPLAKMHGAFSTNVVASKELQ<br>QPGSARSTRHLEIELPKEASYQEGDHLGVIPRNYEGIVNRVTARFGLDASQQIRLEAEEEKLA<br>HLPLAKTVSVEELLQYVELQDPVTRTQLRAMAAKTVCPPHKVELEALLEKQAYKEQVLAKR<br>LTMLELLEKYPACEMKFSEFIALLPSIRPRYYSISSSPRVDEKQASITVSVVSGEAWSGYGEYK<br>GIASNYLAELQEGDTITCFISTPQSEFTLPKDPETPLIMVGPGTGVAPFRGFVQARKQLKEQG<br>QSLGEAHLYFGCRSPHEDYLYQEELENAQSEGIITLHTAFSRMPNQPKTYVQHVMEQDGKKL<br>IELLDQGAHFYICGDGSQMAPAVEATLMKSYADVHQVSEADARLWLQQLEEKGRYAKDVW<br>AG | |
| CYP3A4-1 | MALIPDLAMETWLLLAVSLVLLYLYGTHSHGLFKKLGIPGPTPLPFLGNILSYHKGFCMFDM<br>ECHKKYGKVWGFYDGQQPVLAITDPDMIKTVLVKECYSVFTNRRPFGPVGFMKSAISIAEDE<br>EWKRLRSLLSPTFTSGKLKEMVPIIAQYGDVLVRNLRREAETGKPVTLKDVFGAYSMDVITS<br>TSFGVNIDSLNNPQDPFVENTKKLLRFDFLDPFFLSITVFPPLIPILEVLNICVFPREVTNFLRK<br>SVKRMKESRLEDTQKHRVDFLQLMIDSQNSKETESHKALSDLELVAQSIIIFIFAGYETTSSVLS<br>FIMYELATHPDVQQKLQEEIDAVLPNKAPPTYDTVLQMEYLDMVVNETLRLFPIAMRLERV<br>CKKDVEINGMFIPKGVVVMIPSYALHRDPKYWTEPEKFLPERFSKKNKDNIDPYIYTPFGSGP<br>RNCIGMRFALMNMKLALIRVLQNFSFKPCKETQIPLKLSLGGLLQPEKPVVLKVESRDGTVS<br>GA | 84 |
| CYP3A4-2 | MALIPDLAMETWLLLAVSLVLLYLYGTHSHGLFKKLGIPGPTPLPFLGNILSYHKGFCMFDM<br>ECHKKYGKVWGFYDGQQPVLAITDPDMIKTVLVKECYSVFTNRRPFGPVGFMKSAISIAEDE<br>EWKRLRSLLSPTFTSGKLKEMVPIIAQYGDVLVRNLRREAETGKPVTLKDVFGAYSMDVITS<br>TSFGVNIDSLNNPQDPFVENTKKLLRFDFLDPFFLSIIFPFLIPILEVLNICVFPREVTNFLRKS<br>VKRMKESRLEDTQKHRVDFLQLMIDSQNSKETESHKALSDLELVAQSIIIFIFAGYETTSSVLSF<br>IMYELATHPDVQQKLQEEIDAVLPNKAPPTYDTVLQMEYLDMVVNETLRLFPIAMRLERVC<br>KKDVEINGMFIPKGVVVMIPSYALHRDPKYWTEPEKFLPERFSKKNKDNIDPYIYTPFGSGP<br>RNCIGMRFALMNMKLALIRVLQNFSFKPCKETQIPLKLSLGGLLQPEKPVVLKVESRDGTVS<br>GA | 85 |
| McaCYP82-4 | MIMMFIDYYSSWLPQTLLLQSILLAVSLVIFINLFLTRRRSYSSKSHTNIIHPPKAAGALPVIGH<br>LYTLF<br>RGLSAGVPLYRQLDAMADRYGPAFIIHLGVYPTLVVTCRELAKECFTTNDQTFATRPSTCAG<br>KYIGYNYA<br>FFGFAPYGPYWREARKIATVELLSNYRLDSLRHVREAEVGRNVDELYALHASSSTNKQNMM<br>KIDMKQWFD<br>QVTLNVILMMVVGKRCVTTGGNEEEVRVVKVLHEFFKHLGTLSVSDVVPYVEWMDLDGNI<br>GRMKSTAKEL<br>DCILGRWLEEHRRERRSDFMDAMLAMVEGIKIPYYDSDTVIKAICLNLLNAGSDTLGITMTW<br>ALSLLLNN<br>RHVLKKVKDELDVHVGKNRQVEELDVKNLVYLHAVVKETLRLFPPAPLGVPHEAMEDCVV<br>GGFHVAKGTR<br>LVVNVWKLHRDPSVWSDPLAFKPERFLDNNTVDVRGQHFQLLPFGSGRRGCPGITFALQVA<br>HLTLARLLH<br>GFEWDTPDGAPVDMSEVSVLTTAKKNPVEVLFTPRLPAEVYTQN | 86 |
| NsaCYP82-4 | MLSIHDSTMVFLQLQAICGIFGFIFIITWWTRWKSSNKMKAPEVAGAWPVIGHLHLLGGGRP<br>LYQLLGDM<br>SDKYGPAFTLRMGIQKALVVSSWEVAKECLTTNDRALATRPSSAGGKYMGYNNALIPFSPYG<br>PYWRDMRK<br>IATLELLSNHRLEELKHVREMEINTCISDMYKLCQVEDGVEIKPISVDLSQWFADLTFNVVV<br>MMITGKRY<br>IGSTDAGDMNEIRHFQAALVKFMRLLRISLLVDVFPVLQWINYGGFKGVMKSTARDIDSVLE<br>NWLQEHQR<br>KRLSPDFNGNHDFIDVMISTLEGTEFSDYDHNTIIKAISMAMVVGGTDTTTTTLIWAISLLLN<br>NPNAMKK<br>VQEELEIHVGKERNVDGSDIQHLVYLQAVVKETLRLYPPVPLSVMHQAMEDCVIGSYNIQAG<br>TRVLFNLW<br>KLHRDSSVWSDPLEFRPERFLTSHVDVDVRGQHFELIPFGSRRSCPGISFALQVIHLTIARLF<br>HGFNLT<br>TPGNSSVDMSEISGATLSKVTPLEVLVTPRLSSKLYN | 87 |
| HcaCYP82-10 | MDSLLQLQIIGALAALIFTYKLLKVICRSPMTDGMEAPEPPGAWPIIGHLHLLGGQDPIARTL<br>GVMTDKY<br>GPILKLRLGVHTGLVVSNWELAKECFTTNDRVLASRPMGAAGKYLGYNYAIFGLAPHGPYW<br>SEVRKIVLR<br>ELLSNQSLEKLKHVRISEINTCLKNLFSLNNGNTPIKVDMKQWFERPMFNVVTMMIAGKRY<br>FSMENDNEA<br>MNFRKVATEFMYLTGVFVVSDALPYLEWLDLQGHVSAMKRTAKELDIHVGKWLEEHRRAK<br>LLGETKNEDD<br>FVDVLLTILPEDLKDNQTYIHDRDTIIKATALALFLAASDTTAITLTWALSLILNNPDVLKRA<br>QDELDKH | 88 |

TABLE 5-continued

N-demethylase candidate enzymes

| Name | Sequence | SEQ ID NO: |
|---|---|---|
| | VGKEKLVKESDIINLVYLQAIIKETLRLYPAAPLLLPHEAMEDCTVGGYHVPKGTRIFVNIWK<br>LQRDPRV<br>WFDPNEFRPERFLTTHANVDFKGQHFEYIPFSSGRRVCPGITFSTQIMHLTLAHLLHEFNIVT<br>PTKSNAG<br>VDMTESLGITMPKATPLEVLLTPRLPSNLYNQYRD | |
| EcaCYP82-7 | MNLLIFFQFLLQFQVLVGLSVLLAFSYYLWVSKNPKINKFKGKGALLAPQAAGAWPIVGHLP<br>QLVGPKPL<br>FRILGAMADNYGPIFMLRFGVHPTVVVSSWEMTKECFTTNDRHLASRPSNAASQYLIYEVYA<br>LFGFSLYG<br>SSYWRDARKIATLELLSHRRLELLKHVPYTEIDTCIKQLHRLWTKNNKNQNNPELKVEMNQ<br>FFTDLTMNV<br>ILKLVVGKRFFNVDDAADHEKEEARKIQGTIFEFFKLTEGSVSAGALPLLNWLDLNGQKRAM<br>KRTAKKMD<br>SIAEKLLDEHRQKRLSKEGVKGTHDHNDFMDVLLSILDADQGDYSHHPFNYSRDHVIKATTL<br>SMILSSMS<br>ISVSLSWALSLLLNNRHVLKKAQDELDMNVGKDRQVEEGDIKNLVYLQAIVKETFRMYPAN<br>PLLLPHEAI<br>EDCKIGGFNVPAGTRVVVNAWKLQHDPRVWSNPSEFKPERFLNDQAAKVVDVRGQNFEYL<br>PFGSGRRVCP<br>GISFSLQTIHMSLARLVQAFELGTPSNERIDMTEGSGLTMPKTTPLHVLLNPRLPLPLYE | 89 |
| GflCYP82-8 | MELINSLEIQPITISILALLTVSILLYKIIWNHGSRKNNKSNKNNRKTSSSAGVVEIPGAWPIIG<br>HLHLF<br>NGSEQMFHKLGSLADQYGPAPFFIRFGSRKYVVVSNWELVKTCFTAQSQIFVSRPPMLAMNI<br>LFFPKDSL<br>SYIQHGDHWRELRKISSTKLLSSHRVETQKHLIASEVDYCFKQLYKLSNNGEFTLVRLNTWC<br>EDMALNVH<br>VRMIAGMKNYVAAPGSGEYGGQARRYRKALEEALDLLNQFTITDVVPWLGWLDHFRDVVG<br>RMKRCGAELD<br>SIFATWVEEHRVKRASGKGGDVEPDFIDLCWESMEQLPGNDPATVIKLMCKEHIFNGSGTSS<br>LTLAWILS<br>LIMNNPYVIKKAREELEKHVGNHRQVEESDLPNLLYIQAIIKEGMRLYTPGPFIDRNTTEDYE<br>INGVHIP<br>AGTCLYVNLWKIHRDPNVYEDPLEFKPERFLKNNSDLDLKGQNYQLLPFGAGRRICPGVSLA<br>LPLMYLTV<br>SRLIHGFDMKLPKGVEKADMTAHGGVINQRAYPLEVLLKPRLTFQQA | 90 |
| SdiCYP82-3 | MTIGALALLSFIYFLRVSVIKRTKYTNTAVTATNKLENDEDEANHSKRVVAPPEVAGAWPIL<br>GHLPQLVG<br>LKQPLFRVLGDMADKYGPIFIVRFGMYPTLVVSSWEMAKECFTTNDRVLASRPASASGKYLT<br>YNYAMFGF<br>TNGPYWREIRKISMLELLSHRRVELLKHVPSTEIDSSIKQLYHLWVENQNQNKQGDHQVKV<br>DMSQLLRDL<br>TLNIVLKLVVGKRLFNNNDMDHEQDEAARKLQKTMVELIKVAGASVASDALPFLGWLDVD<br>GLKRTMKRIA<br>KEIDVIAERWLQEHRQKKLTSNDKGGSNNIQGGGGDNDFMDVMLSILDDDSNFFINYNRDT<br>VIKATSLTM<br>ILAGSDTTTLSLTWALTLLATNPGALRKAQDELDTKVGRDRQVDERDIKNLVYLQAIVKETL<br>RMYPAAPL<br>AIPHEATQDCIVGGYHVTAGTRVWVNLWKLQRDPHAWPNPSEFRPERFLAVENDCKQQGT<br>CDGEAANMDF<br>RGQHFEYMPFGSGRRMCPGINFAIQIIHMTLARLLHSFELRVPEEEVIDMAEDSGLTISKVTP<br>LELLLTP<br>RLPLPLYI | 91 |
| SdiCYP82-6 | FCQFQGIVGILLAFLTFLYYLWRASITGLRTKPKHNDFKVTKAAPEADGAWPIVGHFAQFIGP<br>RPLFRIL<br>GDMADKYGSIFMVRFGMYPTLVVSSWEMAKECFTTNDRFLASRPASAAGKYLTYDFAMLSF<br>SFYGPYWRE<br>IRKISMLELLSHRRVELLKHVPSTEIDSSIKQLYHLWVENQNQNKQGDHQVKVDMSQLLRDL<br>TLNIVLKL<br>VVGKRLFNNNDMDHEQDEAARKLQKTMVELIKVAGASVASDALPFLGWLDVDGLKRTMK<br>RIAKEIDVIAE<br>RWLQEHRQKKLTSNDKGGSNNIQGGGGDNDFMDVMLSILDDDSNFFINYNRDTVIKATSLT<br>MILAGSDTT<br>TLSLTWALTLLATYPLCALRKAQDELDTKVGRDRQVDERDIKNLVYLQAIVKETLRMYPAA<br>PLAIPHEAT<br>QDCIVGGYHVTAGTRVWVNLWKLQRDPHAWPNPSEFRPERFLAVENDCKQQGTCDGEAA<br>NMDFRGQHFEY<br>MPFGSGRRMCPGINFAIQIIHMTLARLLHSFELRVPEEEVIDMAEDSGLTISKVTPLELLLTPR<br>LPLPLY<br>I | 92 |

TABLE 5-continued

N-demethylase candidate enzymes

| Name | Sequence | SEQ ID NO: |
|---|---|---|
| CmaCYP82-6 | MDLFIFFSRFQYIVGLLAFLTFFYYLWRVSITGTRIKTNQNIMNGTNMMAPEAAGAWPIVGH LPQLVGPQ PLFKILGDMADKYGSIFMVRFGMHPTLVVSSWEMAKECFTTNDKFLASRPTSAGGKYLTYD FAMFGFSFY GPYWREIRKISTLELLSHRRVELLKHVPYTEIGGSIKQLYKLWMETQNQNKQRDDHQVKVD MSQVFGYLT LNTVLKLVVGKGLFNNNDMNHEQEEGRKLHETVLEFFKLAGVSVASDALPFLGWLDVDGQ KRSMKRIAKE MDLIAERWLQEHRQKRLTSNNKASSGHDDFMSVLLSILDDDSNFFNYNRDTVIKATSLNLIL AASDTTSV SLTWVLSLLVTNPGALKKVQDELDTKVGRNRHVEERDIEKLVYLQATVKETLRMYPAGPLS VPHEATQDC TVGGYQVTAGTRLVVNVWKLQRDPRVWPNPSEFKPERFLPDGCEVGCGEAANMDFRGQH FEYIPFGSGRR MCPGIDFAIQIIHMTLACLLHAFEFQVPSSLDKHLVPAVIDMSEGSGLTMPKVTPLEVLLNPR LPLPLYE L | 93 |
| EcaCYP82-5 | MEKPILLQLQPGILGLLALMCFLYYVIKVSLSTRNCNQLVRHPPEAAGSWPIVGHLPQLVGSG KPLFRVL GDMADKFGPIFMVRFGVHPTLVVSSWEMAKECFTSNDKFLASRPPSAASIYMAYDHAMLGF SSYGPYWRE IRKISTLHLLSHRRLELLKHVPHLEIHNFIKGLYGIWKDHQKQQQQPTARDDQDSVMLEMSQ LFGYLTLN IVLSLVVGKRVCNYHADGHLDDGEEAGQGQKLHQTITDFFKLSGVSVASDALPFLGLFDLDG QKKIMKRV AKEMDFVAERWLQDKKSSLLLSSKSNNKQNEAGEGDVDDFMDVLMSTLPDDDDSFFTKYS RDTVIKANSL SMVVAGSDTTSVSLTWALSLLLNNIQVLRKAQDELDTKVGRDRHVEEKDIDNLVYLQAIVKE TLRMYPAG PLSVPHEAIEDCNVGGYHIKTGTRLLVNIWKLQRDPVWSNPSEFRPERFLDNQSNGTLLDF RGQHFEYI PFGSGRRMCPGVNLATPILHMTLARLLQSFDLTTPSSSPVDMTEGSGLTMPKVTPLKVLLTP RLPLPLYD Y | 94 |
| PbrCYP82-5 | MDVAIIVDHHYLQPFVSIAGLLALLSFFYCIWVFIIRPRIIKSNLDERKLSPSSPPEVAGAWPIV GHLPQ LIGSTPLFKILADMSNKYGPIFMVRFGMYPTLVVSSWEMSKECFTTNDRLFATRPPSAAGKY LTKALFAF SVYGPYWREIRKISTIHLLSLRRLELLKHGRYLEIDKCMKRLFEYWMEHHKNIISTTSSVKVN MSQVFAE LSLNVVLKIIVGKTLFIKNGNEDYTKEEEEGQKLHKTILKFMELAGVSVASDVLPFLGWLDVD GQKKQMK RVYKEMNLIASKVVLGEHRERKRLQIIQKRGAARGSNYDDGNDFMDVLMSILDEENDDLFFG YSRDTVIKS TCLQLIVAASDTTSLAMTWALSLLLTNPNVLQKAQDELDTKVGRDRIIEEHDIECLVYLQAIV KETLRLY PPAPLSLPHEAMEDCTVGGYQVKAGTRLVVNLWKLQRDPRVWSNPLEFKPERFLPQSDGG FGGEEARMDF RGQHFEYTPFGSGRRICPGIDFFLQTVHMALARLLQAFDFNTAGGLVIDMVEGPGLTMPKVT PLEVHLNP RLPVTLY | 95 |
| PbrCYP82-6 | MQVDWPNILQKYYPIITCSLLTLLSFYYIWVSITKPSRNSKTKLPPPEVAGSWPIVGHLPQLV GSTPLFK ILANMSDKYGPIFMVRFGMHPTLVVSSWEMSKECFTTNDKFLASRPPSASAKYLGYDNAMF VFSDYGPYW REIRKISTLQLLTHKRLDSLKNIPYLEINSCVKTLYTRWAKTQSQIKQNVGGAADDFVKVDM TEMFGHLN LNVVLRLVVGKPIFIQKDNADEDYTKDGHNKEELGQKLHKTIIEFFELAGASVASDVLPYLG WLDVDGQK KRMKKIAMEMDLFAQKWLEEHRQKGINHDNENDFMAVLISVLGEGKDDHIFGYSRDTVIK ATCLTLIVAA TDTTLVSLTWALSLLLTNPRVLSKAQDELDTVVGKERNVEDRDVNHLVYLQAVIKETLRLY PPSPLAVPH EAIENCNVGGYEVKARTRLLVNLWKIHRDPRVWSNPLEFKPERFLPKLDGGTGEASKLDFK GQDFVYTPF GSGRRMCPGINFASQTLHMTLARLLHAFDFDIESNGLVIDMTEGSGLTMPKVTPLQVHLRPR LPATLY | 96 |

TABLE 5-continued

N-demethylase candidate enzymes

| Name | Sequence | SEQ ID NO: |
|---|---|---|
| McaCYP82-4 | MIMMFIDYYSSWLPQTLLLQSILLAVSLVIFINLFLTRRRSYSSKSHTNIIHPPKAAGALPVIGH LYTLF RGLSAGVPLYRQLDAMADRYGPAFIIHLGVYPTLVVTCRELAKECFTTNDQTFATRPSTCAG KYIGYNYA FFGFAPYGPYWREARKIATVELLSNYRLDSLRHVREAEVGRNVDELYALHASSSTNKQNMM KIDMKQWFD QVTLNVILMMVVGKRCVTTGGNEEEVRVVKVLHEFFKHLGTLSVSDVVPYVEWMDLDGNI GRMKSTAKEL DCILGRWLEEHRRERRSDFMDAMLAMVEGIKIPYYDSDTVIKAICLNLLNAGSDTLGITMTW ALSLLLNN RHVLKKVKDELDVHVGKNRQVEELDVKNLVYLHAVVKETLRLFPPAPLGVPHEAMEDCVV GGFHVAKGTR LVVNVWKLHRDPSVWSDPLAFKPERFLDNNTVDVRGQHFQLLPFGSGRRGCPGITFALQVA HLTLARLLH GFEWDTPDGAPVDMSEVSVLTTAKKNPVEVLFTPRLPAEVYTQN | 86 |
| NsaCYP82-4 | MLSIHDSTMVFLQLQAICGIFGFIFIITWWTRWKSSNKMKAPEVAGAWPVIGHLHLLGGGRP LYQLLGDM SDKYGPAFTLRMGIQKALVVSSWEVAKECLTTNDRALATRPSSAGGKYMGYNNALIPFSPYG PYWRDMRK IATLELLSNHRLEELKHVREMEINTCISDMYKLCQVEDGVEIKPISVDLSQWFADLTFNVVV MMITGKRY IGSTDAGDMNEIRHFQAALVKFMRLLRISLLVDVFPVLQWINYGGFKGVMKSTARDIDSVLE NWLQEHQR KRLSPDFNGNHDFIDVMISTLEGTEFSDYDHNTIIKAISMAMVVGGTDTTTTTLIWAISLLLN NPNAMKK VQEELEIHVGKERNVDGSDIQHLVYLQAVVKETLRLYPPVPLSVMHQAMEDCVIGSYNIQAG TRVLFNLW KLHRDSSVWSDPLEFRPERFLTSHVDVDVRGQHFELIPFGSGRRSCPGISFALQVIHLTIARLF HGFNLT TPGNSSVDMSEISGATLSKVTPLEVLVTPRLSSKLYN | 87 |
| HcaCYP82-10 | MDSLLQLQIIGALAALIFTYKLLKVICRSPMTDGMEAPEPPGAWPIIGHLHLLGGQDPIARTL GVMTDKY GPILKLRLGVHTGLVVSNWELAKECFTTNDRVLASRPMGAAGKYLGYNYAIFGLAPHGPYW SEVRKIVLR ELLSNQSLEKLKHVRISEINTCLKNLFSLNNGNTPIKVDMKQWFERPMFNVVTMMIAGKRY FSMENDNEA MNFRKVATEFMYLTGVFVVSDALPYLEWLDLQGHVSAMKRTAKELDIHVGKWLEEHRRAK LLGETKNEDD FVDVLLTILPEDLKDNQTYIHDRDTIIKATALALFLAASDTTAITLTWALSLILNNPDVLKRA QDELDKH VGKEKLVKESDIINLVYLQAIIKETLRLYPAAPLLLPHEAMEDCTVGGYHVPKGTRIFVNIWK LQRDPRV WFDPNEFRPERFLTTHANVDFKGQHFEYIPFSSGRRVCPGITFSTQIMHLTLAHLLHEFNIVT PTKSNAG VDMTESLGITMPKATPLEVLLTPRLPSNLYNQYRD | 88 |
| EcaCYP82-7 | MNLLIFFQFLLQFQVLVGLSVLLAFSYYLWVSKNPKINKFKGKGALLAPQAAGAWPIVGHLP QLVGPKPL FRILGAMADNYGPIFMLRFGVHPTVVVSSWEMTKECFTTNDRHLASRPSNAASQYLIYEVYA LFGFSLYG SSYWRDARKIATLELLSHRRLELLKHVPYTEIDTCIKQLHRLWTKNNKNQNNPELKVEMNQ FFTDLTMNV ILKLVVGKRFFNVDDAADHEKEEARKIQGTIFEFFKLTEGSVSAGALPLLNWLDLNGQKRAM KRTAKKMD SIAEKLLDEHRQKRLSKEGVKGTHDHNDFMDVLLSILDADQGDYSHHPFNYSRDHVIKATTL SMILSSMS ISVSLSWALSLLLNNRHVLKKAQDELDMNVGKDRQVEEGDIKNLVYLQAIVKETFRMYPAN PLLLPHEAI EDCKIGGFNVPAGTRVVVNAWKLQHDPRVWSNPSEFKPERFLNDQAAKVVDVRGQNFEYL PFGSGRRVCP GISFSLQTIHMSLARLVQAFELGTPSNERIDMTEGSGLTMPKTTPLHVLLNPRLPLPLYE | 89 |
| GflCYP82_8 | MELINSLEIQPITISILALLTVSILLYKIIWNHGSRKNNKSNKNNRKTSSSAGVVEIPGAWPIIG HLHLF NGSEQMFHKLGSLADQYGPAPFFIRFGSRKYVVVSNWELVKTCFTAQSQIFVSRPPMLAMNI LFFPKDSL SYIQHGDHWRELRKISSTKLLSSHRVETQKHLIASEVDYCFKQLYKLSNNGEFTLVRLNTWC EDMALNVH VRMIAGMKNYVAAPGSGEYGGQARRYRKALEEALDLLNQFTITDVVPWLGWLDHFRDVVG RMKRCGAELD SIFATWVEEHRVKRASGKGGDVEPDFIDLCWESMEQLPGNDPATVIKLMCKEHIFNGSGTSS LTLAWILS LIMNNPYVIKKAREELEKHVGNHRQVEESDLPNLLYIQAIIKEGMRLYTPGPFIDRNTTEDYE INGVHIP | 90 |

TABLE 5-continued

N-demethylase candidate enzymes

| Name | Sequence | SEQ ID NO: |
|---|---|---|
| | AGTCLYVNLWKIHRDPNVYEDPLEFKPERFLKNNSDLDLKGQNYQLLPFGAGRRICPGVSLA<br>LPLMYLTV<br>SRLIHGFDMKLPKGVEKADMTAHGGVINQRAYPLEVLLKPRLTFQQA | |
| SdiCYP82-3 | MTIGALALLSFIYFLRVSVIKRTKYTNTAVTATNKLENDEDEANHSKRVVAPPEVAGAWPIL<br>GHLPQLVG<br>LKQPLFRVLGDMADKYGPIFIVRFGMYPTLVVSSWEMAKECFTTNDRVLASRPASASGKYLT<br>YNYAMFGF<br>TNGPYWREIRKISMLELLSHRRVELLKHVPSTEIDSSIKQLYHLWVENQNQNKQGDHQVKV<br>DMSQLLRDL<br>TLNIVLKLVVGKRLFNNNDMDHEQDEAARKLQKTMVELIKVAGASVASDALPFLGWLDVD<br>GLKRTMKRIA<br>KEIDVIAERWLQEHRQKKLTSNDKGGSNNIQGGGGDNDFMDVMLSILDDDSNFFINYNRDT<br>VIKATSLTM<br>ILAGSDTTTLSLTWALTLLATNPGALRKAQDELDTKVGRDRQVDERDIKNLVYLQAIVKETL<br>RMYPAAPL<br>AIPHEATQDCIVGGYHVTAGTRVWVNLWKLQRDPHAWPNPSEFRPERFLAVENDCKQQGT<br>CDGEAANMDF<br>RGQHFEYMPFGSGRRMCPGINFAIQIIHMTLARLLHSFELRVPEEEVIDMAEDSGLTISKVTP<br>LELLLTP<br>RLPLPLYI | 91 |
| SdiCYP82-6 | FCQFQGIVGILLAFLTFLYYLWRASITGLRTKPKHNDFKVTKAAPEADGAWPIVGHFAQFIGP<br>RPLFRIL<br>GDMADKYGSIFMVRFGMYPTLVVSSWEMAKECFTTNDRFLASRPASAAGKYLTYDFAMLSF<br>SFYGPYVVRE<br>IRKISMLELLSHRRVELLKHVPSTEIDSSIKQLYHLWVENQNQNKQGDHQVKVDMSQLLRDL<br>TLNIVLKL<br>VVGKRLFNNNDMDHEQDEAARKLQKTMVELIKVAGASVASDALPFLGWLDVDGLKRTMK<br>RIAKEIDVIAE<br>RWLQEHRQKKLTSNDKGGSNNIQGGGGDNDFMDVMLSILDDDSNFFINYNRDTVIKATSLT<br>MILAGSDTT<br>TLSLTWALTLLATYPLCALRKAQDELDTKVGRDRQVDERDIKNLVYLQAIVKETLRMYPAA<br>PLAIPHEAT<br>QDCIVGGYHVTAGTRVWVNLWKLQRDPHAWPNPSEFRPERFLAVENDCKQQGTCDGEAA<br>NMDFRGQHFEY<br>MPFGSGRRMCPGINFAIQIIHMTLARLLHSFELRVPEEEVIDMAEDSGLTISKVTPLELLLTPR<br>LPLPLY<br>I | 92 |
| CmaCYP82-6 | MDLFIFFSRFQYIVGLLAFLTFFYYLWRVSITGTRIKTNQNIMNGTNMMAPEAAGAWPIVGH<br>LPQLVGPQ<br>PLFKILGDMADKYGSIFMVRFGMHPTLVVSSWEMAKECFTTNDKFLASRPTSAGGKYLTYD<br>FAMFGFSFY<br>GPYWREIRKISTLELLSHRRVELLKHVPYTEIGGSIKQLYKLWMETQNQNKQRDDHQVKVD<br>MSQVFGYLT<br>LNTVLKLVVGKGLFNNNDMNHEQEEGRKLHETVLEFFKLAGVSVASDALPFLGWLDVDGQ<br>KRSMKRIAKE<br>MDLIAERWLQEHRQKRLTSNNKASSGHDDFMSVLLSILDDDSNFFNYNRDTVIKATSLNLIL<br>AASDTTSV<br>SLTWVLSLLVTNPGALKKVQDELDTKVGRNRHVEERDIEKLVYLQATVKETLRMYPAGPLS<br>VPHEATQDC<br>TVGGYQVTAGTRLVVNVWKLQRDPRVVVPNPSEFKPERFLPDGCEVGCGEAANMDFRGQH<br>FEYIPFGSGRR<br>MCPGIDFAIQIIHMTLACLLHAFEFQVPSSLDKHLVPAVIDMSEGSGLTMPKVTPLEVLLNPR<br>LPLPLYE<br>L | 93 |
| EcaCYP82-5 | MEKPILLQLQPGILGLLALMCFLYYVIKVSLSTRNCQLVRHPPEAAGSWPIVGHLPQLVGSG<br>KPLFRVL<br>GDMADKFGPIFMVRFGVHPTLVVSSWEMAKECFTSNDKFLASRPPSAASIYMAYDHAMLGF<br>SSYGPYVVRE<br>IRKISTLHLLSHRRLELLKHVPHLEIHNFIKGLYGIWKDHQKQQQQPTARDDQDSVMLEMSQ<br>LFGYLTLN<br>IVLSLVVGKRVCNYHADGHLDDGEEAQGQKLHQTITDFFKLSGVSVASDALPFLGLFDLDG<br>QKKIMKRV<br>AKEMDFVAERWLQDKKSSLLLSSKSNNKQNEAGEGDVDDFMDVLMSTLPDDDDSFFTKYS<br>RDTVIKANSL<br>SMVVAGSDTTSVSLTWALSLLLNNIQVLRKAQDELDTKVGRDRHVEEKDIDNLVYLQAIVKE<br>TLRMYPAG<br>PLSVPHEAIEDCNVGGYHIKTGTRLLVNIWKLQRDPRVWSNPSEFRPERFLDNQSNGTLLDF<br>RGQHFEYI<br>PFGSGRRMCPGVNLATPILHMTLARLLQSFDLTTPSSSPVDMTEGSGLTMPKVTPLKVLLTP<br>RLPLPLYD<br>Y | 94 |

TABLE 5-continued

N-demethylase candidate enzymes

| Name | Sequence | SEQ ID NO: |
|---|---|---|
| PbrCYP82-5 | MDVAIIVDHHYLQPFVSIAGLLALLSFFYCIWVFIIRPRIIKSNLDERKLSPSSPPEVAGAWPIV GHLPQ LIGSTPLFKILADMSNKYGPIFMVRFGMYPTLVVSSWEMSKECFTTNDRLFATRPPSAAGKY LTKALFAF SVYGPYWREIRKISTIHLLSLRRLELLKHGRYLEIDKCMKRLFEYWMEHHKNIISTTSSVKVN MSQVFAE LSLNVVLKIIVGKTLFIKNGNEDYTKEEEEGQKLHKTILKFMELAGVSVASDVLPFLGWLDVD GQKKQMK RVYKEMNLIASKVVLGEHRERKRLQIIQKRGAARGSNYDDGNDFMDVLMSILDEENDDLFFG YSRDTVIKS TCLQLIVAASDTTSLAMTWALSLLLTNPNVLQKAQDELDTKVGRDRIIEEHDIECLVYLQAIV KETLRLY PPAPLSLPHEAMEDCTVGGYQVKAGTRLVVNLWKLQRDPRVWSNPLEFKPERFLPQSDGG FGGEEARMDF RGQHFEYTPFGSGRRICPGIDFFLQTVHMALARLLQAFDFNTAGGLVIDMVEGPGLTMPKVT PLEVHLNP RLPVTLY | 95 |
| PbrCYP82-6 | MQVDWPNILQKYYPIITCSLLTLLSFYYIWVSITKPSRNSKTKLPPPEVAGSWPIVGHLPQLV GSTPLFK ILANMSDKYGPIFMVRFGMHPTLVVSSWEMSKECFTTNDKFLASRPPSASAKYLGYDNAMF VFSDYGPYW REIRKISTLQLLTHKRLDSLKNIPYLEINSCVKTLYTRWAKTQSQIKQNVGGAADDFVKVDM TEMFGHLN LNVVLRLVVGKPIFIQKDNADEDYTKDGHNKEELGQKLHKTIIEFFELAGASVASDVLPYLG WLDVDGQK KRMKKIAMEMDLFAQKWLEEHRQKGINHDNENDFMAVLISVLGEGKDDHIFGYSRDTVIK ATCLTLIVAA TDTTLVSLTWALSLLLTNPRVLSKAQDELDTVVGKERNVEDRDVNHLVYLQAVIKETLRLY PPSPLAVPH EAIENCNVGGYEVKARTRLLVNLWKIHRDPRVWSNPLEFKPERFLPKLDGGTGEASKLDFK GQDFVYTPF GSGRRMCPGINFASQTLHMTLARLLHAFDFDIESNGLVIDMTEGSGLTMPKVTPLQVHLRPR LPATLY | 96 |
| PbrCYP82-7 | MMDLAMFIDQYFSLAKIAGLLALLSFFYYLWISTLWSPRNPKLSSVSPPEVAGAWPILGHLP QLLGSRPL FKILADMSDNYGPIFMVRFGMHPTLVVSSWEMAKECFTTNDRFLAGRPSGAANKYLTFALF GFSTYGPYW REIRKIATLHLLSHRRLELLKHVPDLEVTNCMKHLHRRWIDSQNQIKQNDAAAGSVKVDMG RVFGELTLN VVLKLVAGKSIFFKNDNTRQYDSKDGHNKEEEEGKKLHKTIIDFYSLAGASVASDVLPFLGW LDVDGQKK RMKRVAKDMDFIAAKWLEEHRQKRQTVLSSSATLGSSNHDDAKDFMDVLMSILDGEND DLFFGYSRDTV IKTTCLQLIAAAADTTSVTMTWALALLITNPTILRKAQDELDTKVGKDRNIEERDINDLVYLQ AIVKETL RMYPAGPLNVPHEAIADCNIGGYEVRAGTRLLVNLWKMHRDPRVWSNPSEFKPERFLPQL DGGSGGEAAN LDFRGQDFEYLPFSAGRRMCPGIDFSLQTLHMTLARLLHGFDFNNDSAGIIIDMEEGSGLTM PKLTPLEI YLCPRLPAKLY | 97 |

TABLE 6

N-methyltransferase and N-modifying candidate enzymes

| Name | Sequence | SEQ ID NO: |
|---|---|---|
| TfCNMT | MAVEGKQVAPKKAIIVELLKKLELGLVPDDEIKKLIRIQLGRRLQWGCKSTYEEQIAQLVNLTHSLRQMKIATEVETLDDQMY EVPIDFLKIMNGSNLKGSCCYFKNDSTTLDEAEIAMLELYCERAQIKDGHSVLDLGCGQGALTLYVAQKYKNSRVTAVTNSV SQKEFIEEESRKRNLSNVEVLLADITTHKMPDTYDRILVVELFEHMKNYELLLRKIKEWMAKDGLLFVEHICHKTFAYHYEPID EDDWFTEYVFPAGTMIIPSASFFLYFQDDVSVVNHWTLSGKHFSRTNEEWLKRLDANVELIKPMFVTITGQCRQEAMKLIN YWRGFCLSGMEMFGYNNGEEWMASHVLFKKK | 98 |
| CjCNMT | MAVEAKQTKKAAIVELLKQLELGLVPYDDIKCILIRRELARRLQWGYKPTYEEQIAEIQNLTHSLRQMKIATEVETLDSQLYEIPI EFLKIMNGSNLKGSCCYFKEDSTTLDEAEIAMLDLYCERAQIQDGQSVLDLGCGQGALTLHVAQKYKNCRVTAVTNSVSQK EYIEEESRRRNLLNVEVKLADITTHEMAETYDRILVIELFEHMKNYELLLRKISEWISKDGLLFLEHICHKTFAYHEPLDDDDW FTEYVFPAGTMIIPSASFFLYFQDDVSVVNHWTLSGKHFSRTNEEWLKRLDANLDVIKPMFETLMGNEEEAVKLINYWRGF CLSGMEMFGYNNGEEWMASHVLFKKK | 99 |

TABLE 6-continued

N-methyltransferase and N-modifying candidate enzymes

| Name | Sequence | SEQ ID NO: |
|---|---|---|
| PsCNMT | MQLKAKEELLRNMELGLIPDQEIRQLIRVELEKRLQWGYKETHEEQLSQLLDLVHSLKGMKMATEMENLDLKLYEAPMEFL KIQHGSNMKQSAGYYTDESTTLDEAEIAMLDLYMERAQIKDGQSVLDLGCGLGAVALFGANKFKKCQFTGVTSSVEQKDYI EGKCKELKLTNVKVLLADITTYETEERFDRIFAVELIEHMKNYQLLLKKISEWMKDDGLLFVEHVCHKTLAYHYEPVDAEDWY TNYIFPAGTLTLSSASMLLYFQDDVSVVNQWTLSGKHYSRSHEEWLKNMDKNIVEFKEIMRSITKTEKEAIKLLNFWRIFCM CGAELFGYKNGEEWMLTHLLFKKK | 100 |
| PsTNMT | MGSIDEVKKESAGETLGRLLKGEIKDEELKKIKFQFEKRLQWGYKSSHQEQLSFNLDFIKSLKKMEMSGEIETMNKETYELPS EFLEAVFGKTVKQSMCYFTHESATIDEAEEAAHELYCERAQIKDGQTVLDIGCGQGGLVLYIAQKYKNCHVTGLTNSKAQVN YLLKQAEKLGLTNVDAILADVTQYESDKTYDRLLMIEAIEHMKNLQLFMKKLSTWMTKESLLFVDHVCHKTFAHFFEAVDED DWYSGFIFPPGCATILAANSLLYFQDDVSVVDHWWNGMHMARSVDIWRKALDKNMEAAKEILLPGLGGSHETVNGVV THIRTFCMGGYEQFSMNNGDEWMVAQLLFKKK | 101 |
| EcTNMT | MGSSAGEIMGRLMKGEIEDEELKKLIRHQWDRRIEWGYKPTHEKQLAFNLDFIKGLKEMVMSGEIDTMNKETYELPTAFLE AVFGKTVKQSCCYFKDENSTIDEAEEEAAHELYCERAQIKDGQTVLDIGCGQGGLVLYIAEKYKNCHVTGLTNSKAQANYIEQ QAEKLELTNVDVIFADVTKFDTDKTYDRILVVETIEHMKNIQLFMKKLSTWMTEDSLLFVDHISHKTFNHNFEALDEDDWYS GIFPKGCVTILSSSTLLYFQDDVSALDHWVVNGMHMARSVEAWRKKLDETIEAAREILEPGLGSKEAVNQVITHIRTFCIGG YEQFSYNNGEEWMITQILFKKK | 102 |
| PsRNMT | MSTTMETTKISQQDDLWKNMELGQISDEEVRRLMKIGIEKRIKWGTKPTQQEQLAQLLDFNKSLRGMKMATEIDTLENHK IYETPESFNQIIGGKESAGLFTDETTTTMEEANTKMMDLYCERAGLKDGHTILDLGCGAGLLVLHLAKKYKKSKITGITNTSSH KEYILKQCKNLNLSNVEIILADVTKVDIESTFDRVFVIGLIEHMKNFELFLRKISKWMKDDGLLLLEHLCHKSFSDHWEPLSEDD WYAKNFFPSGTLVIPSATCLLYFQEDVTVIDHWILSGNNFARSNEVILKRIDGKIEEVKDIFMSFYGIGREEAVKLINWWRLLC ITANELFKYNNGEEWLISQLLFKKKLMTCI | 103 |
| TfPNMT | METKQTKKEAVANLIKRIEHGEVSDEEIRGMMKIQVQKRLKWGYKPTHEQQLAQLVTFAQSLKGMEMAEEVDTLDAELYE IPLPFLHIMCGKTLKFSPGYFKDESTTLDESEVYMMDLYCERAQIKDGQSILDLGCGHGSLTLHVAQKYRGCKVTGITNSVSQ KEFIMDQCKKLDLSNVEIILEDVTKFETEITYDRIFAVALIEHMKNYELFLKKVSTWIAQYGLLFVEHHCHKVFAYQYEPLDEDD WYTEYIFPSGTLVMSSSSILLYFQEDVSVVNHWTLSGKHPSLGFKOWLKRLDDNIDEVKEIFESFYGSKEKAMKFITYWRVFC IAHSQMYSTNNGEEWMLSQVLFKKK | 104 |
| PbrTNMT1 | MGSIDEVKKESAGETLGRLLKGEIKDEELKKIKFQFEKRLQWGYKSSHQEQLSFNLDFIKSLKKMEMSGEIETMNKETYELPS EFLEAVFGKTVKQSMCYFKHESATIDEAEEAAHELYCERAQIKDGQTVLDIGCGQGGLVLYIARKYKKCHVTGLTNSKAQVN YLLKQAEKLGLTNVDAILADVTQYESDKTYDRLLMIEAIEHMKNLQLFMKKLSTWMTEESLLFVDHVCHKTFAHFFEAVDED DWYSGFIFPPGCATILAANSLLYFQDDVSVVDHWVVNGMHMARSVDIWRKALDKNMEAAKEILLPGLGGSHEAVNGVV THIRTFCMGGYEQFSMNDGDEWMVAQLLFKKK | 105 |
| PbrTNMT2 | MGSIEEVKKESAEETLGRLLRGEINDEELKKIKYQLEKRLQWGYKSSHQEQLSFNLDFINSLKKMGMSGQVEAFTNEVYELP TECFEAAYGKSMKLSGCYFKHESSTIDEAEEASHELYCERAQIKDGQTVLDIGCGQGGLVLYVAQKYKNCHVTGLTNSKEQV NYILKQAEKLGLRNVDVILADVTQYESDKTYDRILVIGVVEHMKNMQLFIKKLSTWMAEDSLLFVDHSCHKTFNHHFEALDE DDWYSGYIFPPGCATFLSADSLLYFQDDVSVVDHWVVNGMHFARTVDAWRKKLDKNMEAVKEILLPGLGGNHEAVNGV ITHIRTCCVGGYVQFSLNDGDEWMNAQLLFKKK | 106 |
| AmeNMT1 | MCLFFAEKMGLMAEANNQQQLKKEDLLKNMELGLIPDEEIRKLIRVQLEKRLNWGYKSTHEQQLSQLLHLVHSLKKMKIAT EMENLDLKLYEAPFSFVQIQHGSTIKESSGLFKDESTTLDEAEIAMLDLYTKRAKIEDGQSVLDLGCGLGAVTLYVAQKFKNCY VTGITSSVEQKDFIEGRCKELKLSNVKVILADITTYETEEKYNRIFAVELIEHMKNYELLLRKISEWMKQDGLLFIEHVCHKTLAY HYEPLDEEDWYTNYIFPAGTLTLSSATLLLYFQDDVAVVDQWTLSGKHYSRSHEEWLKRIDGNIEEVKEIMKSITKSEEEAKKL LNFWRIFCMCGAELFGYKNGEEWMMTHILFKKK | 107 |
| GflNMT1 | MDLMATSKQVKKKEELLKNMELGLVPDEEIRRLIRIELEKRLKWGYKPTHQQQLAQLLDVHSLKKMKIATEMESLDLKLYE APFSFVQIKHGSTIKESSSYFKDESMTLDEAEIAMLDLYVERAQIEDGQSVLDLGCGLGAVTLHVAKKYKNCHVTGLTNSVEQ KDFIEGKCKELNLSNVKVILADVTSHEMEDKFDRIFAVELIEHMKNYELLLRRISKWMKDDGLLFIEHVCHKTFAYHYEPIDED DWYTEYIFPAGTLTLSSASLLLYFQDDVSVVNHWTLSGKHYSRSHEEWLKRIDGNMDAVKEIMKSITKTEEEAVKLINFWRIF CMCGAELFGYKDGEEWMMSHVLFKKKQLLQQC | 108 |
| EcaNMT1 | MVDLKVEKEELLKSMELGLVPDEDIRKHIRSQLEKRLKWGYKPNHEQQLAQLLDVIHSLKKMKISKEYESFDLRLYEAPFDFH KIQLGTHLKESCSYYKDESTTLDEAEGAMLDLYTQKAKIEDGQSILDLGCGVGAVTLFVANKYKNCKVTGITSCQWQKDFIE NKCKELNLTNVRVIIGDVTAYEMEETFDRIFAIELIEHMKNYELLLRKISKWMKDDGLLFIEHVCHKILAYPYEPIDEEDWPTEY IFPGGTLTLSSASLLLYFQDDVSVVEHSSLNGKHYSRSHGEWLKNIDANIDEVKGIMRSITKTEEEAVRLVNFWRIFCMCGIEL FGYNNGEEWMVSHILLKKK | 109 |
| EcaNMT2 | MAADLVVKKWNNKKELIDEMELGLVGDEEIRELIRNDLEKRLKWGYKSNHEQQLAQLLHFVHSLRGMKIAADEVESFNIKV YEAPFSFNKIQLGSSLKESSCYYKHDETTLDEGEIAMMELYTEKAQIKDGSILTLYVANKYPNCKVTGTTASL WHKDFIESKCKEQELTNVKIVLGDATTHEMEERFDRILAIGLIEHLKNYGLLLGRISKWLKDDGFLFIQHVCHKTLAYPLVPVD EEDWIGEYIFPGGTLTMPSASLLLYFQDELSVVDHSTLNGKHFSRTHEEWLKNIDAKIDEVKEILKSVTKTEEEVVRLTNFWRI FCMFGVEMFGYNEGEEWMLSQILFKKK | 110 |
| CmaNMT4 | MASGKVVDLLKRLDSGLVSDEELRRVIRFELERRLKWGYKPTHEQQLAELLNLAHATKQMEIATKIDTLNSTMYEVPNSFLEI QLGSTLKESCLYFKDESTTVDEAEIAMMDLYERAQIKDGQIILDLGCGLGALAFHIAQKYTNCNVTSVTNSVKQKEFIEEKCK ILNVSNVKVILTDICTLEMEATFDRIFAIGLIEHMKNYELLLRKFSAWMKQDGLLFIEHLCHKTLGYHNEPIDEDDWYTAYFFP AGTLTFIPSSFLLYFQDDVSVVNHWTLSGKHFSRSNEEWLKRMDNKIDEVKEIYKAAASETKDDDIMKLIRLWRFLSISAAE MFGYKDGEEWMISQVLFKKK | 111 |
| EcNMT3 | MASLVEEGSFVNNKESVKERVSELVKRLKNGLVSDEELRKLMRVELEKRLEWGYKSTHEQQLSQLIDLAHSMKKMEIAMEI DALNSTVYEVPLSFLQIIIHGTTIKESCLYFKDESTTVDEAEIAMMDLYLERAQIKDGQSILDLGCGLGGFSPHIASKFTGCNITA VTNSVKQKEFIEEKCKTLNVPNIKVILADICTTEIENVFDRIIAIGLIEHMKNYELLLKKFSKWMTQDGLLFIEHLCHKTFGYHNE | 112 |

TABLE 6-continued

N-methyltransferase and N-modifying candidate enzymes

| Name | Sequence | SEQ ID NO: |
|---|---|---|
| | PLDEDDWYTTYFFPAGTLTFIPSSFLLYFQDDVSVVDHWTLNGKHFARSNEEWLKRMDEKMDEVKQIFRSNLKSENEVTKT IGEWRFLSMSAAEMFGYNNGEEWMVSQLLFKKK | |
| GflNMT5 | MGSNETNGELKTKEMVPDLLKRLESGLVADEELRKLIRFELERRLKWGYKPTHEQQLAELLKLAHSTKQMKIATETDSLNST MYEVPIPFLQLQFGSAIKESCCYFKDESTTLDEAEVAMMDLYLERTQIKDGQSILDLGCGLGALAFHIVQKYPNCNVLAITNS VEQKEFIEEKCKIRVENVKVSLADICTLEMKTTFDRIFAIGLLEHMKNYQLLLKKFSNWMKQDGLLFIEHLCHKTLAYHYEPL DEDDWYTEYFFPAGTLTIISSSFLLYFQDDVSIVNHWSLSGKHFSRSNEEWLKRMDKIDEVKEILEAAFENKDHDITKLINH WRFLAINATEMFGYNNGEEWMVSQVLFKKK | 113 |
| ScaNMT1 | MASDHEVSNKELKKKKEVITELLKRLESGLVSDEELRGLIRFELERRLRWGYKPTHEQQLAQLLNLAHSMKQMKIATEIDALN STMYEVPIPFLQIQLGSTLKESCCYFKDESTTVDEAEIAMMDLYLERAQIKDGQSILDLGCGLGALAFHIAQKYTNCNITAITN SVRQKEFIEEKCKILNVSNVKVSLADICTLEMEATFDRIFAIGLIEHMKNYELLLKKFSEWMKQDGLIFIEHLCHKTLAYHYEPL DEDDWYTEYFFPAGTLTLISSSFLLYFQDDVSVVDHWTLSGKHFSRSNEEWLKRMDEKIDEVKEIFESVSDSKDDDVTKLINH WRFFCISSAEMFGYNNGEEWMISQVLFKKK | 114 |
| CchNMT3 | MIKKSKIMAFSDHHHEVVKNHSKKEMIADLLKRLEAGLVPDEEMRNLFRFELERRLQWGYKSIHQEQLSQLLKLAHSTKEM TIVAEMDALNSSMYELPISFLQIQLGSNLKQSSLYFKDELTTVDEAEVAIMDLYLERAQIEDGQSILDLGCGLGAFSFHVARKY TNCNITAVTNSLTQKEFIEKKSKILNIQNVKVIFADVTTVEMETTFDRVFAIGLIEHMQNYELFLKKLSKWMKQDGLLFIEHFC HKTLAYHYKPIDEDDWFTNLLYPNGTVISSSLLLYFQDDVSVVDHWSLSGKHFSRASEESLKRMDAKMDEMKEIFESITDSK EEAMKLINQWRIFCISCAEMFGYNNGEEWMTSHFLFKKKL | 115 |
| CchNMT6 | MGSSTASDHEMVIMENDSKNKQVVIADLLKRLVGGLVPDEEMRNMFRFELEKRLKWGYKSTHQQQLSQLLNLVELNKGI AKIAPEMDALNSAMYEVPIPYLKLMLGSTLKQSCLYFKDESTTLDEAEIEMMDLYLERADIQDGQSILDLGCGLGGLGFHIAQ KYISCNITALTNSLTQKEFIEEKCKTLNIPNVKVILADVTTVEIETTFDRLFAIGLVEHMENYELFLRKLSKWMKQDGLLFIEHLC HKTLAYHYKPIDEDDWYSNLLYPTGTLTSASFLLYFQDDLSVVDHWSLSGKHFSRATEEWLKMIDANMDKIREIYESVTESKE EATRSINQWRIFCISCAEMFGYNDGEEWMISHFLFKNKKQIE | 116 |
| CchNMT1 | MATSDQEVKTSKMEMIADLLKRLEAGLVPDDEIRSLIRVELERRLKWGYKSTHQEQLDQLLNLAHSIKKMKIASTEMDGLTS TMYEVPISLVQIQLGSHLKESCLYFKDETTTVDEAEIAMMDLYLERAQIKDGQSILDLGCGLGAVSFHIAQKYTSCNITAVTNS VRQKEFIEEKSKTLNVPNVKVLLADITTLEMEHTFDRLFAISLIEHMENYELLLRKLSEWMKQDGLLFIEHLCHKTLSYHFEPM DEDDWYTNLLFPAGTLTLVSASFLLYFQDDLSVVNQWVMSGKHFSRANEEWLKNMDAKMDEMREIFESITDSEEEVVKLI NHWRIFCISSAEMFAYNDGEEWMNSHVLFKKKKQIQ | 117 |
| CchNMT2 | MAGSGANKEMIADLLKRLEVGLVPDEEIRSLIRFQLKRRLKWGYKTTHQEQLEQLLSLAHSIRKMKIATEMDALNSTMYEVP ISFMQIVFGSTLKESCLYFKDEATTVNEAEIAMMDLYLERAQIKDGQSILDLGCGMGSLCFHIARKYTNCNITAVTNSVSQKE FIEEKSKTLNLPNVKVILADITTLEMDDTYDCLFAIGLIEHMKNYELLLRKLSNWMKQDSLLFIDHVCHKTLAYHYEPIDEDDW YTNLLFPAGTLTLVSASFLLYFQDDLSLVDHWSMSGKHFSRTNKEWLKNIDGKMDKIREIVKSITDSEEEVVKLINHWRMLCI NSSEMFGFNDGEEWMNSHVLFKKKKQI | 118 |
| ScaNMT2 | MEMIADLLKRLEAGLVPDDEIRSLIRVELERRLKWGYKSTHQEQLDQLLNLAHSIKKMKIASTEMDGLTSTMYEVPISLVQIQ LGSHLKESCLYFKDEATEIAMMDLYLERAQIKDGQSILDLGCGLGAVSFHIAQKYTSCNITAVTNSVSQKEFIEEKSKTL NVPNVKVLLADITTLEMDDTFDCLFAIGLIEHMENYELLLRKLSDWMKQDGLLFIDHVCHKTLSYHFEPMDEDDWYTNLLF PAGTLTLVSASFLLYFQDDLSLVDHWSMSGKHFSRTNKEWLKNIDGKMDKIREIVKSITDSEEEVVKLINHWRMLCINSSEM FGFNDGEEWMNSHVLFKKKKQI | 119 |
| PbrNMT2 | MCTTMDTTKISQQDDLWKNMELGLISDEEVRRLMKIETEKRIKWGTKPTQQEQLAQLLDFNKSLRGMKMATEVHALENH KIYEIPDSFNQIIGGKESAGLFTDEATTTIEEANTKMMDLYCERAGLKDGQTILDIGCGAGLLVLHLAKKYKNCITGVTNTSW HKEHILEQCKNLNLSNVEVILADVTTVDIERTFDRVFVIGLIEHMKNFELFLRKISKWMKDDGLLFLEHLCHKFSFDHWEPLSE DDWYAKNFFPSGTLVIPSATCLLYFQEDVTVKDHWLLSGNNFARSNEAILKRIDSKIEEVKDIFMSFYGIGEEEAVKLINWWR LLCITANELFKYNNGEEWLISQLLFKKKLMTCI | 120 |
| PbrNMT1 | MVKGDQFQTTTMEETKISQENDLWTNMELGLIPDEEVRRLMKIEIEKRIEWGMKPTQHQQLAQLLDFTKSLRGMKMATE LDKLDSKLYETPHSFNQIVNGSTLKESSGLYTDVTTTMDEASIKMMDLYCERANIKDGQTILDLGCGPGPLVLHIAKKYSNCKI TGVTNAFSQREYILEECKKLSLSNVEIILADVTSLDLETTFDRVFVIGFIEHMKNFELFLRKISKWMKDDAVLFLEHFCHKSFSY HGEPLSEDDWYAKNFFAPGTLVIPSATCLLYFQEDLAVIDHWFLSGNHFARTNEEMLKGIDGKIEEIKDIFMSFYGINEAEAV KLINWWRLFCITGAEMFSYNNGEEWFISQLLFKKK | 121 |
| EcaNMT4 | MALEQEDSMSVPERNEGVADLIKRMELGLVNDEEIRRLMRIQIENRLKWGYKPTHDQQLAQHLHFINSLKEMKMATEMD SLDSQVYESPNSFQQIMCGRSMKESAGLFMDDVTTVEEAHIRMMDLYCDKATFEDGQKILDLGCGHGSVVLHVAQKYKG CQVTGVTNSSAQKQYILEQCKKLDLSNVEIILADVTTLEMEEKFDRVIIIGLIEHMKNFKLFFQKVSKWMKEGGLLFLENYFHK DFAYHCEKIDEDDWYDGYIFPPGSLLMPSASTLLYFQEDLTVADHWVLPGTHFAKTFEEFLKKIDLRIEEVREIFEAFYGISKEE AMKLSNYWRNFCISAMEIFNYNNGQEWMISHLLYTKK | 122 |
| CmaNMT5 | METGKNNQNMKTTIDDLWNQMMLGIVPDKEIRRLMKIELKKRLDWGYRPTHQQQLSQLLDFAKGLCNYCWTALRCMK MSAEFDTLDSKVYETPKSFQQIMCGTTIKESSGLFMNESTTLDQAQISMLDLYFDKAKIKDGQSILDLGCHGALILYLAQKY QNCNITGVTNSLSQKEFIVEKCKKLGLSNVEILLADVTKLEMEDMFDRVFVIGLIEHMKNFELFLRKISEWMKPDGLLFLEHY CHKSFAHQWEPIDEEDWFSKYIFPPGTVIIPSASFLLYFQEDVKVIDHWTLSGNHFARTQEEWLKGIDGHIDEVEKTFESFYGI SKEEAVKLINFWRVFCLSGVEMFGYNNGEEWMISHLLFKKK | 123 |
| GflNMT4 | MTMEANNAKKEAIENLWEQMMMGLVPDHEITRLMKSELQKRLNWGYKPTHQQQISQLLDFAKSLRRMEMS LDFDNLELDTKMYETPESFQLIMSGTTLKESSGLFTDETATLDQTQIRMMDLYLEKAKIKDGQSILDLGC GHGALILHVAQKYRNCVTGVTNSIAQKEFIFKQCKKLGLSNVEMVLADVTKCEMKATFDHIFVIGLIEH MKNFELFLRKVSEWMKSDGLLFMEHYCHKSFAYQWEPMDDDDLFSKYVFPPGSAIIPSASFLLYFQDDLT VVDHWTLSGNHFARTHQEWLKRIDSQSDEIKGIFESFYGISKEEAVKLINYWRVFCLFGVEMFGYNNGEE WMISHLLFKKK | 124 |

TABLE 6-continued

N-methyltransferase and N-modifying candidate enzymes

| Name | Sequence | SEQ ID NO: |
|---|---|---|
| CchNMT5 | MEVVATSSARNPKKEIVDLWKRMELGLIPDEEIRDLMKIGLEKRLKWGYKPTHEQQLSQLLHFAKSLRSM KMASEMETLDDQMYETPTAFQQLMCGSTIKESAGFFKDESTTLDEAEIKMLDLYCEKARIEDGQKILDLG CGHGAVMLHIAQKYKNCNVTGVTNSISQQQFIVQRSKELNLSNVNMILADVTMLEMDATYDRIFIIGLIE HMKNFELFLRKISKWITKEGLLFLEHYCHKTFAYQCEPVDEDDWYNMFIFPPGTLILPSASFLLYFQDDL IVVDRWTLNGNHYARTQEEWLKRIDANVDGVKQMFESVCDGNKEEAVKLMNFWRIFCISGAEMLAYNNGE EWMISHYLFKKRN | 125 |
| NsNMT2 | MEATQITKKQGVAELIKRIENGQVPDEEITRMMKIQIQKRLKLGYKSTHEQQLAQLLHFVHSLQKMEMAE EVDTLDSELYEIPLPFLHIMCGKALKFSPGYFKDESTTLDESEVNMLDLYCERAQIEDGQTILDLGCGHG SLTLHVAKKYRGCKVTGITNSVSQKDFIMEECKKLNLSNVEIILEDVTKFETGTTYDRIFAVALIEHMKN YELFLKKVSAWMAQDGLLFVEHHCHKVFAYKYEPIDDDDWYTEYIFPTGTLVMSSSSILLYFQEDVSVVN HWTLSGKHPSLGFKQWLKRIDDNIDEIKEIFESFYGSKEKATKFITYWRVFCIAHSEMYATNGGEEWMLS QVLFKRK | 126 |
| ScaNMT5 | MGGVADLLKKMELGLVPEEEIRRLMRIIIEKRLEWGYKPTHAEQLDHLTNFIQCLRGMKMADEIDALDAK MYEIPLPFMQTICGSTLKFSPGYFKDESTTLDESEIHMMDLYCERAEVKDGHSILDLGCGHGGFVLHVAQ KYKNSIVTGVTNSVAEKEFIMTQCKKLCLSNVEIILADVTKFEPETTYDRVFAIALIEHMKNYELVLEKL SKWVAQDGFLFVEHHCHKVFPYKYEPLDEDDWYTEYIFPGGTIVLPSASILLYFQKDVSVVNHWSLNGKH PARGFKEWLKRLDENMDAVKAIFEPFYGSKEEAMKWITYWRVFCITHSEMYAYNNGEEWMLSQVLFKRK | 127 |
| JdiNMT1 | MSKGVAKLVERMELGLVSDDEVRRLMRILIEKRLKWGYKPTHEEQLTYLTNFIQGLKGMKIAEEIDALDA KMYEIPIAFMQILCGYSLKFSPGFFEDESTTLDESETIMMDLYCERAQVQDGQSILDLGCGHGGFVLHVA QKYKNCKVTGVTNSVSETEYIMEQCKKLGLSNVEIIADVTKFEPEVTYDRVFAIALIEHMKNYELVLQK LSKWVAQDGFLFVDHHCHKVFPYKYEPIDEDDWYTQYIFPGGTLVLPSASILLYFQEDVSIVNHWTLSGN HPARGFKEWLKRLDDNMDEIKAIFEPFYGSKEEAMKWITYWRVFCITHSEMYAYNNGEEWMISQVLFKRK | 128 |
| BthNMT1 | MEVKQAGKEGVTELLVKRMELGLVPEEEIRRLMRIQIQKRLDWGYKPTHEEQLAHLTKFIQNIRGMKMAD EIDALDAKMYEIPLPFLQTICGKTLKFSPGYFKDESTTLDESETLMMDLYCERAQVKDGQSILDLGCGHG GFVLHLAQKYRNSVVTGVTNSVSETEYIKEQCKKLGLSNVEIIADVTKFEPEVTYDRVFAIALIEHMKN YALVLNKISKWVAQDGYLFVEHHCHKVFPYKYEPLDEDDWYTNYIFPGGTLILPSASILLYFQEDVTVLN HWSLSGKHPSRGFIEWLKRLDENIDVIMGIFEPFYGSKEEATKWINYWRVFCMTHSEMYAYGNGEEWMLS QVLLKRK | 129 |
| MaqNMT3 | MELGLVPEKEIRRLMRIQIQKRLEWGYKPTHEEQLAHLTKFIQNIRGMKMADEIDALDAKMYEIPLPFLQ TICGKTLKFSPGYFKDESTTLDESETLMMDLYCERAQVKDGQSILDLGCGHGGFVLHLAQKYRNSIVTGV TNSVSETEYIKEQCKKLGLSNVEIIADVTKFEPEVTYDRVFAIALIEHMKNYALVLNKISKWVAQDGYL FVEHHCHKVFPYKYEPLDEDDWYTNYIFPGGTLILPSASILLYFQEDVTVLNHWSLSGKHPSRGFIEWLK RLDENIDVIMGIFEPFYGSKEEATKWINYWRVFCITHSEMYAYGNGEEWMLSQVLLKRK | 130 |
| McaNMT4 | MDKANERELKRAELFKKLEDDLVTYDEIKQVMRTELAKRLEWGYKPTHQQLAHLLDFAHALEGMKIANE VETLASEVYETPLPFXEIVLGPAKKXSSCLFEDESTTLEQAEIAMLDLYFERAQIRXGMSVLDLGCGXGS VGLHIARKYKNCXVTCITNSISQKQYIENQCKLYNLSNVKIILADIVAHDTDDTFDVVLVIGVIEHMKNY ALLLLNKISKWMAKDGLLFVEHLCHKTFPYHFEPLDEDDWYSNFVFPTGTLTMPSVSFLLYFQADVSILNH WILSGKNFSRTXEEFLKRIDANVDAIKDGLKPSLGSEGVAKLISYWRGFCLTGMEMFGYNNGEEWMSQV LFKNK | 131 |
| TcoNMT3 | MEDNNNLLQEEMNVVELLQRPELGLVPDEKIRKLTRLQLQKRLKWGYKPTHEAQLSHLFQFIHSLPSLNM ESEDENPKSWLYETPTSFLQLLYGDCIKESDTYYKEDTATLEEAVINMLELYCERARITEGLSVLDLGC YGALTLHVAQKYKSCKVTGVTSSISQKQYIMEKCKKLNLTNVEIILADVATIEIEAASYDRIFALGIFEH VNDYKLFLGKLSKWMKQDGLLFVEYLCHKTFPYQNKPLDKGDKWYNEYVFPSGGLIIPSASFILYFQNDV SVVRQWTQGGQHSARTFEELLKRIDGNIDKIKEIFIESYGKEDAVRFINYWRVFLITGVEMFSYNDGEE WMGAHFLFKKKFIMQE | 132 |
| CmuNMT4 | MEVKQSKGDELRSRVAELLERPELGLVPDEEIRRLAKARLEKRLKWGYKATHGEQLSSLLQFVESLPSLN MASEDDSPKAWLYETPTSFLQLIYGDIIKESGSYYKDESTTLEEAMIHNMNLLCCERANIKEGQSVVDLGC GYGAFILHVAQKYKTCRVTGITSSISQKHYIMEQCKKLNLSNVEILADVATIKLDATFDRVFAAGMFEH VNDYKSFLRKITNWMKPDGRLFVEHLCNKTFPYQNKPLDDGDNWGEYVFPSGGLIIPSASLLLYFQEDVS IVNHWTFSGKHAANKFEELLKRIDAKIDAIKRIFNECYGSKDSIRFINYWRVFLITAAEMFGYNNGEEWM GVHLLFKKK | 133 |
| CtrNMT2 | GLKSSVAELLERPELGLVPDGEIRKLTKTRLAKRLEWGYKATHEDQLSHLLRFIHSLPSLNMASEDDSPK AWLYETPTSFLQLIYGDIIKESGTYYKDESSTLEEAIIHNMDLCCERARIKEGQSVLDLGCGYGAFTLHV AQKYKSCSVTGITSSISQKDYIMEQCKKLNLSNVEVILADVATIKMNTTFDRVFALGMFEHINDYKLFLR RISNWMKHDGLLFVEHLCNKTFAYQNKPLDDGDDWFNEYVFPSAGLIIPSASLLLYFQEDVSIVHHWTFS GKHAAYKFEELLERIDAKIEAIKEIFIECYGSKEDAIRFINYWRVFLITAAEMFAYRDGEEWMGSHVLFK KK | 134 |
| CmuNMT5 | MEAKQHESNNNIDEELKNRVNIGEQEERPGFEDEEIRRLAKAQLAKRLKWGYKPTHEQQLSHLLQFLQSL PSLNMASEDESSKAWLYETPTSFLQLLFGNVIKFSGYYYKHESSTFEESMIHNMDLCCERANIKEGQNVI DLGCGYGAFVLHVAQKYKSCSVTGITCSITQKHHIMEECKKLNLCNVKILADVATIELGTAFDRVFAFG MFEEINDYKLILRKISNWMKPDGLFFVEHCHKTLAYQNKLIDDQDWYEEYIFPSGGLIVPSASLLLYFQ DDLSVVYHWTYNGKHGARSFEKMLERTDANIDTIKDMFTEFYGSKEKAIKFINYWRVFFITAAEMFAYND GEEWMCSQLLFKKK | 135 |

TABLE 6-continued

N-methyltransferase and N-modifying candidate enzymes

| Name | Sequence | SEQ ID NO: |
|---|---|---|
| CmuNMT8 | MEHKIEDIRKLKSRVEEQLERPELGLVKDEDIKTLAKAKLEKRLKWGYKPTYAEQLSNLLQFAQSLPSLK MENVDDQGSSKQWLYGVPSEFLQIIYGGIIKMSGSYYEDESTTLEESMIKDMDSCCEKANVKEGHSVLDI GCGYGSLIIHIAKKYRTCNVTGITNFVEQKQYIMEECKKLNLSNVEIVGDGTTINLNTTTFDRVFVTGM LEEINDYKLFLKSVSDWMKPDGLLLVTHFCHKTFAYQNNKALDDEDWHNEYIFPSGNLIVPSASLLLYFQ EDLSVVSHWATNGTHTGRTCKKLVERIDANIEKIKEIFSEFYGSKEDAIRMINYWRVLCITGAEMYTCKD GEEWMDVYYLFKKK | 136 |

TABLE 7

Variants of BM3 N-demethylase

| BM3 variant | Genotype | SEQ ID NO: |
|---|---|---|
| 8F11 | L437A | |
| 4H9 | L181A, T260A, L437A | |
| 8C7 | L75A, L181A | |
| 4H5 | L75A, M177A, L181A | |
| 7A1 | L75A, M177A, L181A, T260A | |

| BM3 variant | Amino Acid Sequence | |
|---|---|---|
| 8F11 | MTIKEMPQPKTFGELKNLPLLNTDKPVQALMKIADELGEIFKFEAPGRVTRYLSSQ RLIKEACDESRFDKNLSQALKFARDFAGDGLVTSWTHEKNWKKAHNILLPSFSQQ AMKGYHAMMVDIAVQLVQKWERLNADEHIEVSEDMTRLTLDTIGLCGFNYRFNSF YRDQPHPFIISMVRALDEVMNKLQRANPDDPAYDENKRQFQEDIKVMNDLVDKII ADRKARGEQSDDLLTQMLNGKDPETGEPLDDGNIRYQIITFLIAGHETTSGLLSFAL YFLVKNPHVLQKVAEEAARVLVDPVPSYKQVKQLKYVGMVLNEALRLWPTAPAFS LYAKEDTVLGGEYPLEKGDEVMVLIPQLHRDKTVWGDDVEEFRPERFENPSAIPQH AFKPFGNGQRACIGQQFALHEATLVLGMMLKHFDFEDHTNYELDIKETATLKPKG FVVKAKSKKIPLGGIPSPSTEQSAKKVRKKAENAHNTPLLVLYGSNMGTAEGTARD LADIAMSKGFAPQVATLDSHAGNLPREGAVLIVTASYNGHPPDNAKQFVDWLDQA SADEVKGVRYSVFGCGDKNWATTYQKVPAFIDETLAAKGAENIADRGEADASDDF EGTYEEWREHMWSDVAAYFNLDIENSEDNKSTLSLQFVDSAADMPLAKMHGAFS TNVVASKELQQPGSARSTRHLEIELPKEASYQEGDHLGVIPRNYEGIVNRVTARFGL DASQQIRLEAEEEKLAHLPLAKTVSVEELLQYVELQDPVTRTQLRAMAAKTVCPPH KVELEALLEKQAYKEQVLAKRLTMLELLEKYPACEMKFSEFIALLPSIRPRYYSISSS PRVDEKQASITVSVVSGEAWSGYGEYKGIASNYLAELQEGDTITCFISTPQSEFTLPK DPETPLIMVGPGTGVAPFRGFVQARKQLKEQGQSLGEAHLYFGCRSPHEDYLYQEE LENAQSEGIITLHTAFSRMPNQPKTYVQHVMEQDGKKLIELLDQGAHFYICGDGSQ MAPAVEATLMKSYADVHQVSEADARLWLQQLEEKGRYAKDVWAG | 137 |
| 4H9 | MTIKEMPQPKTFGELKNLPLLNTDKPVQALMKIADELGEIFKFEAPGRVTRYLSSQ RLIKEACDESRFDKNLSQALKFARDFAGDGLVTSWTHEKNWKKAHNILLPSFSQQ AMKGYHAMMVDIAVQLVQKWERLNADEHIEVSEDMTRLTLDTIGLCGFNYRFNSF YRDQPHPFIISMVRAADEVMNKLQRANPDDPAYDENKRQFQEDIKVMNDLVDKII ADRMRGEQSDDLLTQMLNGKDPETGEPLDDGNIRYQIIAFLIAGHETTSGLLSFAL YFLVKNPHVLQKVAEEAARVLVDPVPSYKQVKQLKYVGMVLNEALRLWPTAPAFS LYAKEDTVLGGEYPLEKGDEVMVLIPQLHRDKTVWGDDVEEFRPERFENPSAIPQH AFKPFGNGQRACIGQQFALHEATLVLGMMLKHFDFEDHTNYELDIKETATLKPKG FVVMKSKKIPLGGIPSPSTEQSAKKVRKMENAHNTPLLVLYGSNMGTAEGTARD LADIAMSKGFAPQVATLDSHAGNLPREGAVLIVTASYNGHPPDNAKQFVDWLDQA SADEVKGVRYSVFGCGDKNWATTYQKVPAFIDETLAAKGAENIADRGEADASDDF EGTYEEWREHMWSDVAAYFNLDIENSEDNKSTLSLQFVDSAADMPLAKMHGAFS TNVVASKELQQPGSARSTRHLEIELPKEASYQEGDHLGVIPRNYEGIVNRVTARFGL DASQQIRLEAEEEKLAHLPLAKTVSVEELLQYVELQDPVTRTQLRAMAAKTVCPPH KVELEALLEKQAYKEQVLAKRLTMLELLEKYPACEMKFSEFIALLPSIRPRYYSISSS PRVDEKQASITVSVVSGEAWSGYGEYKGIASNYLAELQEGDTITCFISTPQSEFTLPK DPETPLIMVGPGTGVAPFRGFVQARKQLKEQGQSLGEAHLYFGCRSPHEDYLYQEE LENAQSEGIITLHTAFSRMPNQPKTYVQHVMEQDGKKLIELLDQGAHFYICGDGSQ MAPAVEATLMKSYADVHQVSEADARLWLQQLEEKGRYAKDVWAG | 138 |
| 8C7 | MTIKEMPQPKTFGELKNLPLLNTDKPVQALMKIADELGEIFKFEAPGRVTRYLSSQ RLIKEACDESRFDKNLSQAAKFARDFAGDGLVTSWTHEKNWKKAHNILLPSFSQQ AMKGYHAMMVDIAVQLVQKWERLNADEHIEVSEDMTRLTLDTIGLCGFNYRFNSF YRDQPHPFIISMVRAADEVMNKLQRANPDDPAYDENKRQFQEDIKVMNDLVDKII ADRKARGEQSDDLLTQMLNGKDPETGEPLDDGNIRYQIITFLIAGHETTSGLLSFAL | 139 |

TABLE 7-continued

Variants of BM3 N-demethylase

|  |  |  |
|---|---|---|
|  | YFLVKNPHVLQKVAEEAARVLVDPVPSYKQVKQLKYVGMVLNEALRLWPTAPAFS<br>LYAKEDTVLGGEYPLEKGDEVMVLIPQLHRDKTVWGDDVEEFRPERFENPSAIPQH<br>AFKPFGNGQRACIGQQFALHEATLVLGMMLKHFDFEDHTNYELDIKETLTLKPKGF<br>VVKAKSKKIPLGGIPSPSTEQSAKKVRKKAENAHNTPLLVLYGSNMGTAEGTARDL<br>ADIAMSKGFAPQVATLDSHAGNLPREGAVLIVTASYNGHPPDNAKQFVDWLDQAS<br>ADEVKGVRYSVFGCGDKNWATTYQKVPAFIDETLAAKGAENIADRGEADASDDFE<br>GTYEEWREHMWSDVAAYFNLDIENSEDNKSTLSLQFVDSAADMPLAKMHGAFST<br>NVVASKELQQPGSARSTRHLEIELPKEASYQEGDHLGVIPRNYEGIVNRVTARFGLD<br>ASQQIRLEAEEEKLAHLPLAKTVSVEELLQYVELQDPVTRTQLRAMAAKTVCPPHK<br>VELEALLEKQAYKEQVLAKRLTMLELLEKYPACEMKFSEFIALLPSIRPRYYSISSSP<br>RVDEKQASITVSVVSGEAWSGYGEYKGIASNYLAELQEGDTITCFISTPQSEFTLPKD<br>PETPLIMVGPGTGVAPFRGFVQARKQLKEQGQSLGEAHLYFGCRSPHEDYLYQEEL<br>ENAQSEGIITLHTAFSRMPNQPKTYVQHVMEQDGKKLIELLDQGAHFYICGDGSQM<br>APAVEATLMKSYADVHQVSEADARLWLQQLEEKGRYAKDVWAG |  |
| 4H5 | MTIKEMPQPKTFGELKNLPLLNTDKPVQALMKIADELGEIFKFEAPGRVTRYLSSQ<br>RLIKEACDESRFDKNLSQAAKFARDFAGDGLVTSWTHEKNWKKAHNILLPSFSQQ<br>AMKGYHAMMVDIAVQLVQKWERLNADEHIEVSEDMTRLTLDTIGLCGFNYRFNSF<br>YRDQPHPFIISAVRAADEVMNKLQRANPDDPAYDENKRQFQEDIKVMNDLVDKIIA<br>DRMRGEQSDDLLTQMLNGKDPETGEPLDDGNIRYQIITFLIAGHETTSGLLSFALY<br>FLVKNPHVLQKVAEEAARVLVDPVPSYKQVKQLKYVGMVLNEALRLWPTAPAFSL<br>YAKEDTVLGGEYPLEKGDEVMVLIPQLHRDKTVWGDDVEEFRPERFENPSAIPQH<br>AFKPFGNGQRACIGQQFALHEATLVLGMMLKHFDFEDHTNYELDIKETLTLKPKGF<br>VVKAKSKKIPLGGIPSPSTEQSAKKVRKKAENAHNTPLLVLYGSNMGTAEGTARDL<br>ADIAMSKGFAPQVATLDSHAGNLPREGAVLIVTASYNGHPPDNAKQFVDWLDQAS<br>ADEVKGVRYSVFGCGDKNWATTYQKVPAFIDETLAAKGAENIADRGEADASDDFE<br>GTYEEWREHMWSDVAAYFNLDIENSEDNKSTLSLQFVDSAADMPLAKMHGAFST<br>NVVASKELQQPGSARSTRHLEIELPKEASYQEGDHLGVIPRNYEGIVNRVTARFGLD<br>ASQQIRLEAEEEKLAHLPLAKTVSVEELLQYVELQDPVTRTQLRAMAAKTVCPPHK<br>VELEALLEKQAYKEQVLAKRLTMLELLEKYPACEMKFSEFIALLPSIRPRYYSISSSP<br>RVDEKQASITVSVVSGEAWSGYGEYKGIASNYLAELQEGDTITCFISTPQSEFTLPKD<br>PETPLIMVGPGTGVAPFRGFVQARKQLKEQGQSLGEAHLYFGCRSPHEDYLYQEEL<br>ENAQSEGIITLHTAFSRMPNQPKTYVQHVMEQDGKKLIELLDQGAHFYICGDGSQM<br>APAVEATLMKSYADVHQVSEADARLWLQQLEEKGRYAKDVWAG | 140 |
| 7A1 | MTIKEMPQPKTFGELKNLPLLNTDKPVQALMKIADELGEIFKFEAPGRVTRYLSSQ<br>RLIKEACDESRFDKNLSQAAKFARDFAGDGLVTSWTHEKNWKKAHNILLPSFSQQ<br>AMKGYHAMMVDIAVQLVQKWERLNADEHIEVSEDMTRLTLDTIGLCGFNYRFNSF<br>YRDQPHPFIISAVRAADEVMNKLQRANPDDPAYDENKRQFQEDIKVMNDLVDKIIA<br>DRMRGEQSDDLLTQMLNGKDPETGEPLDDGNIRYQIIAFLIAGHETTSGLLSFALY<br>FLVKNPHVLQKVAEEAARVLVDPVPSYKQVKQLKYVGMVLNEALRLWPTAPAFSL<br>YAKEDTVLGGEYPLEKGDEVMVLIPQLHRDKTVWGDDVEEFRPERFENPSAIPQH<br>AFKPFGNGQRACIGQQFALHEATLVLGMMLKHFDFEDHTNYELDIKETLTLKPKGF<br>VVKAKSKKIPLGGIPSPSTEQSAKKVRKKAENAHNTPLLVLYGSNMGTAEGTARDL<br>ADIAMSKGFAPQVATLDSHAGNLPREGAVLIVTASYNGHPPDNAKQFVDWLDQAS<br>ADEVKGVRYSVFGCGDKNWATTYQKVPAFIDETLAAKGAENIADRGEADASDDFE<br>GTYEEWREHMWSDVAAYFNLDIENSEDNKSTLSLQFVDSAADMPLAKMHGAFST<br>NVVASKELQQPGSARSTRHLEIELPKEASYQEGDHLGVIPRNYEGIVNRVTARFGLD<br>ASQQIRLEAEEEKLAHLPLAKTVSVEELLQYVELQDPVTRTQLRAMAAKTVCPPHK<br>VELEALLEKQAYKEQVLAKRLTMLELLEKYPACEMKFSEFIALLPSIRPRYYSISSSP<br>RVDEKQASITVSVVSGEAWSGYGEYKGIASNYLAELQEGDTITCFISTPQSEFTLPKD<br>PETPLIMVGPGTGVAPFRGFVQARKQLKEQGQSLGEAHLYFGCRSPHEDYLYQEEL<br>ENAQSEGIITLHTAFSRMPNQPKTYVQHVMEQDGKKLIELLDQGAHFYICGDGSQM<br>APAVEATLMKSYADVHQVSEADARLWLQQLEEKGRYAKDVWAG | 141 |

| BM3<br>variant | Nucleotide Sequence |  |
|---|---|---|
| 8F11 | ATGACCATCAAAGAAATGCCACAACCTAAGACTTTCGGTGAATTGAAGAATTTGC<br>CTTTGTTGAACACCGATAAGCCAGTTCAAGCTTTGATGAAGATTGCTGATGAATT<br>GGGTGAAATCTTCAAGTTTGAAGCTCCAGGTAGAGTCACTAGATACTTGTCATCTC<br>AAAGATTGATCAAAGAAGCCTGCGACGAATCCAGATTTGATAAGAATTTGTCTCA<br>AGCTTTGAAGTTCGCTAGAGATTTTGCTGGTGATGGTTTGGTTACTTCTTGGACTC<br>ACGAAAAGAATTGGAAGAAGGCCCATAACATTTTGTTGCCATCTTTCTCACAACA<br>AGCCATGAAGGGTTATCATGCTATGATGGTTGATATCGCCGTTCAATTGGTTCAA<br>AAGTGGGAAAGATTGAACGCCGATGAACATATCGAAGTCTCTGAAGATATGACCA<br>GATTGACCTTGGATACCATTGGTTTGTGTGGTTTCAACTACAGATTCAACTCCTTC<br>TACAGAGATCAACCACATCCATTCATCATCTCTATGGTTAGAGCTTTGGATGAAGT<br>CATGAACAAATTGCAAAGAGCTAATCCAGACGATCCAGCTTATGACGAAAACAAG<br>AGACAATTCCAAGAAGATATCAAGGTCATGAACGATTTGGTCGATAAGATTATCG<br>CTGATAGAAAGGCTAGAGGTGAACAATCTGATGATTTGTTGACCCAAATGTTGAA<br>CGGTAAGGATCCAGAAACTGGTGAACCATTGGATGATGGTAACATCAGATACCAA<br>ATTATCACCTTCTTGATTGCTGGTCACGAAACTACATCTGGTTTGTTGTCTTTGC<br>CTTGTACTTTTTGGTTAAGAACCCACACGTCTTGCAAAAGGTTGCTGAAGAAGCTG<br>CAAGAGTTTTGGTTGATCCAGTTCCATCTTACAAGCAAGTCAAGCAATTGAAGTA<br>CGTTGGTATGGTTTTGAACGAAGCTTTGAGATTGTGGCCAACTGCTCCAGCTTTTT<br>CATTATACGCTAAAGAAGATACCGTCTTGGGTGGTGAATATCCATTGGAAAAAGG<br>TGATGAAGTTATGGTCTTGATCCCACAATTGCATAGAGATAAGACTGTTTGGGGT | 142 |

TABLE 7-continued

Variants of BM3 N-demethylase

|  | | |
|---|---|---|
| | GATGATGTCGAAGAATTCAGACCAGAAAGATTCGAAAACCCATCTGCTATTCCAC<br>AACATGCTTTTAAGCCATTTGGTAACGGTCAAAGAGCTTGCATTGGTCAACAATT<br>CGCTTTACATGAAGCTACCTTGGTTTTGGGTATGATGTTGAAACACTTCGACTTCG<br>AAGATCACACCAACTACGAATTGGATATCAAAGAAACCGCTACCTTGAAGCAAA<br>GGGTTTTGTTGTTAAGGCTAAGTCCAAAAAGATTCCATTGGGTGGTATTCCATCT<br>CCATCTACTGAACAATCCGCTAAGAAGGTTAGAAAGAAAGCTGAAAACGCTCATA<br>ACACACCTTTGTTGGTCTTGTACGGTTCTAATATGGGTACTGCTGAAGGTACAGCA<br>AGAGATTTGGCAGATATTGCTATGTCTAAAGGTTTCGCTCCACAAGTTGCTACTTT<br>GGATTCTCATGCTGGTAATTTGCCAAGAGAAGGTGCTGTTTTGATAGTTACTGCT<br>TCTTACAATGGTCACCCACCAGATAATGCTAAGCAATTCGTTGATTGGTTGGATCA<br>AGCTTCAGCTGATGAAGTAAAAGGTGTTAGATACTCTGTTTTCGGTTGCGGTGAC<br>AAAAAATTGGGCTACTACTTATCAAAAGGTTCCAGCCTTTATTGACGAAACTTTGG<br>CTGCTAAAGGTGCTGAAAACATTGCTGACAGAGGTGAAGCTGATGCCTCCGACGA<br>CTTCGAAGGTACTTACGAAGAATGGAGAGAACACATGTGGTCTGACGTTGCTGCT<br>TACTTCAACTTGGACATCGAAAACTCTGAAGACAACAAGTCCACTTTGTCTTTGCA<br>ATTCGTTGACTCCGCTGCTGACATGCCATTGGCTAAGATGCACGGTGCTTTCTCTA<br>CCAACGTCGTTGCCTCCAAGGAATTGCAACAACCAGGTTCTGCTAGATCTACTAGA<br>CACTTGGAAATCGAATTGCCAAAGGAAGCTTCCTACCAAGAAGGTGACCACTTGG<br>GCGTTATTCCAAGAAACTACGAAGGTATCGTCAACAGAGTTACTGCTAGATTCGG<br>TTTGGATGCTTCTCAACAAATCAGATTAGAAGCTGAAGAAGAAAAGTTGGCTCAC<br>TTGCCATTAGCTAAGACTGTCTCCGTTGAAGAATTGTTGCAATACGTCGAATTGCA<br>AGACCCAGTTACCAGAACCCAATTGAGAGCCATGGCTGCCAAGACCGTCTGTCCAC<br>CACACAAGGTTGAATTGGAAGCCTTGTTGGAAAAGCAAGCCTACAAGGAACAAGT<br>TTTGGCTAAGAGATTGACCATGTTGGAATTGTTGGAAAAGTACCCAGCCTGCGAA<br>ATGAAGTTCTCTGAATTTATCGCCTTGTTGCCATCTATCAGACCACGTTACTACTC<br>TATTTCTTCCTCTCCACGTGTTGACGAAAAGCAAGCTTCTATTACTGTTTCCGTTG<br>TCTCCGGTGAAGCTTGGTCCGGTTACGGTGAATACAAGGGTATTGCTTCTAACTAC<br>TTGGCTGAATTGCAAGAAGGTGACACCATTACTTGTTTCATCTCTACTCCACAATC<br>CGAATTTACTTTGCCAAAGGACCCAGAAACTCCATTGATCATGGTTGGTCCAGGTA<br>CTGGTGTCGCTCCATTCAGAGGTTTCGTTCAAGCTAGAAAACAATTGAAGGAACA<br>AGGTCAATCTTTGGGTGAAGCTCACTTGTACTTCGGTTGTAGATCTCCACACGAAG<br>ACTACTTATACCAAGAAGAATTGGAAAACGCTCAATCCGAAGGTATTATCACTTT<br>GCACACCGCTTTCTCCAGAATGCCAAACCAACCAAAGACTTACGTCCAACACGTTA<br>TGGAACAAGACGGTAAGAAGTTGATTGAATTGTTGGACCAAGGTGCTCACTTCTA<br>CATTTGTGGTGATGGTTCTCAAATGGCTCCAGCCGTTGAAGCCACTTTGATGAAGT<br>CTTACGCTGATGTTCACCAAGTTTCCGAAGCCGATGCTAGATTATGGTTGCAACAA<br>TTGGAAGAAAAAGGTCGTTACGCTAAGGATGTCTGGGCCGGTTGA | |
| 4H9 | ATGACCATCAAAGAAATGCCACAACCTAAGACTTTCGGTGAATTGAAGAATTTGC<br>CTTTGTTGAACACCGATAAGCCAGTTCAAGCTTTGATGAAGATTGCTGATGAATT<br>GGGTGAAATCTTCAAGTTTGAAGCTCCAGGTAGAGTCACTAGATACTTGTCATCTC<br>AAAGATTGATCAAAGAAGCCTGCGACGAATCCAGATTTGATAAGAATTTGTCTCA<br>AGCTTTGAAGTTCGCTAGAGATTTTGCTGGTGATGGTTTGGTTACTTCTTGGACTC<br>ACGAAAAGAATTGGAAGAAGGCCCATAACATTTTGTTGCCATCTTTCTCACAACA<br>AGCCATGAAGGGTTATCATGCTATGATGGTTGATATCGCCGTTCAATTGGTTCAA<br>AAGTGGGAAAGATTGAACGCCGATGAACATATCGAAGTCTCTGAAGATATGACCA<br>GATTGACCTTGGATACCATTGGTTTGTGTGGTTTCAACTACAGATTCAACTCCTTC<br>TACAGAGATCAACCACATCCATTCATCATCTCTATGGTTAGAGCTGCAGATGAAGT<br>CATGAACAAATTGCAAAGAGCTAATCCAGACGATCCAGCTTATGACGAAAACAAG<br>AGACAATTCCAAGAAGATATCAAGGTCATGAACGATTTGGTCGATAAGATTATCG<br>CTGATAGAAAGGCTAGAGGTGAACAATCTGATGATTTGTTGACCCAAATGTTGAA<br>CGGTAAGGATCCAGAAACTGGTGAACCATTGGATGATGGTAACATCAGATACCAA<br>ATTATCGCTTTCTTGATTGCTGGTCACGAAACTACATCTGGTTTGTTGTCTTTTGC<br>CTTGTACTTTTTGGTTAAGAACCCACACGTCTTGCAAAAGGTTGCTGAAGAAGCTG<br>CAAGAGTTTTGGTTGATCCAGTTCCATCTTACAAGCAAGTCAAGCAATTGAAGTA<br>CGTTGGTATGGTTTTGAACGAAGCTTTGAGATTGTGGCCAACTGCTCCAGCTTTTT<br>CATTATACGCTAAAGAAGATACCGTCTTGGGTGGTAATATCCATTGGAAAAAGG<br>TGATGAAGTTATGGTCTTGATCCCACAATTGCATAGAGATAAGACTGTTTGGGGT<br>GATGATGTCGAAGAATTCAGACCAGAAAGATTCGAAAACCCATCTGCTATTCCAC<br>AACATGCTTTTAAGCCATTTGGTAACGGTCAAAGAGCTTGCATTGGTCAACAATT<br>CGCTTTACATGAAGCTACCTTGGTTTTGGGTATGATGTTGAAACACTTCGACTTCG<br>AAGATCACACCAACTACGAATTGGATATCAAAGAAACCGCTACCTTGAAGCAAA<br>GGGTTTTGTTGTTAAGGCTAAGTCCAAAAAGATTCCATTGGGTGGTATTCCATCT<br>CCATCTACTGAACAATCCGCTAAGAAGGTTAGAAAGAAAGCTGAAAACGCTCATA<br>ACACACCTTTGTTGGTCTTGTACGGTTCTAATATGGGTACTGCTGAAGGTACAGCA<br>AGAGATTTGGCAGATATTGCTATGTCTAAAGGTTTCGCTCCACAAGTTGCTACTTT<br>GGATTCTCATGCTGGTAATTTGCCAAGAGAAGGTGCTGTTTTGATAGTTACTGCT<br>TCTTACAATGGTCACCCACCAGATAATGCTAAGCAATTCGTTGATTGGTTGGATCA<br>AGCTTCAGCTGATGAAGTAAAAGGTGTTAGATACTCTGTTTTCGGTTGCGGTGAC<br>AAAAAATTGGGCTACTACTTATCAAAAGGTTCCAGCCTTTATTGACGAAACTTTGG<br>CTGCTAAAGGTGCTGAAAACATTGCTGACAGAGGTGAAGCTGATGCCTCCGACGA<br>CTTCGAAGGTACTTACGAAGAATGGAGAGAACACATGTGGTCTGACGTTGCTGCT<br>TACTTCAACTTGGACATCGAAAACTCTGAAGACAACAAGTCCACTTTGTCTTTGCA<br>ATTCGTTGACTCCGCTGCTGACATGCCATTGGCTAAGATGCACGGTGCTTTCTCTA<br>CCAACGTCGTTGCCTCCAAGGAATTGCAACAACCAGGTTCTGCTAGATCTACTAGA<br>CACTTGGAAATCGAATTGCCAAAGGAAGCTTCCTACCAAGAAGGTGACCACTTGG<br>GCGTTATTCCAAGAAACTACGAAGGTATCGTCAACAGAGTTACTGCTAGATTCGG<br>TTTGGATGCTTCTCAACAAATCAGATTAGAAGCTGAAGAAGAAAAGTTGGCTCAC | 143 |

TABLE 7-continued

Variants of BM3 N-demethylase

| | | |
|---|---|---|
| | TTGCCATTAGCTAAGACTGTCTCCGTTGAAGAATTGTTGCAATACGTCGAATTGCA<br>AGACCCAGTTACCAGAACCCAATTGAGAGCCATGGCTGCCAAGACCGTCTGTCCAC<br>CACACAAGGTTGAATTGGAAGCCTTGTTGGAAAAGCAAGCCTACAAGGAACAAGT<br>TTTGGCTAAGAGATTGACCATGTTGGAATTGTTGGAAAAGTACCCAGCCTGCGAA<br>ATGAAGTTCTCTGAATTTATCGCCTTGTTGCCATCTATCAGACCACGTTACTACTC<br>TATTTCTTCCTCTCCACGTGTTGACGAAAAGCAAGCTTCTATTACTGTTTCCGTTG<br>TCTCCGGTGAAGCTTGGTCCGGTTACGGTGAATACAAGGGTATTGCTTCTAACTAC<br>TTGGCTGAATTGCAAGAAGGTGACACCATTACTTGTTTCATCTCTACTCCACAATC<br>CGAATTTACTTTGCCAAAGGACCCAGAAACTCCATTGATCATGGTTGGTCCAGGTA<br>CTGGTGTCGCTCCATTCAGAGGTTTCGTTCAAGCTAGAAAACAATTGAAGGAACA<br>AGGTCAATCTTTGGGTGAAGCTCACTTGTACTTCGGTTGTAGATCTCCACACGAAG<br>ACTACTTATACCAAGAAGAATTGGAAAACGCTCAATCCGAAGGTATTATCACTTT<br>GCACACCGCTTTCTCCAGAATGCCAAACCAACCAAAGACTTACGTCCAACACGTTA<br>TGGAACAAGACGGTAAGAAGTTGATTGAATTGTTGGACCAAGGTGCTCACTTCTA<br>CATTTGTGGTGATGGTTCTCAAATGGCTCCAGCCGTTGAAGCCACTTTGATGAAGT<br>CTTACGCTGATGTTCACCAAGTTTCCGAAGCCGATGCTAGATTATGGTTGCAACAA<br>TTGGAAGAAAAAGGTCGTTACGCTAAGGATGTCTGGGCCGGTTGA | |
| 8C7 | ATGACCATCAAAGAAATGCCACAACCTAAGACTTTCGGTGAATTGAAGAATTTGC<br>CTTTGTTGAACACCGATAAGCCAGTTCAAGCTTTGATGAAGATTGCTGATGAATT<br>GGGTGAAATCTTCAAGTTTGAAGCTCCAGGTAGAGTCACTAGATACTTGTCATCTC<br>AAAGATTGATCAAAGAAGCCTGCGACGAATCCAGATTTGATAAGAATTTGTCTCA<br>AGCTGCTAAGTTCGCTAGAGATTTTGCTGGTGATGGTTTGGTTACTTCTTGGACTC<br>ACGAAAAGAATTGGAAGAAGGCCCATAACATTTTGTTGCCATCTTTCTCACAACA<br>AGCCATGAAGGGTTATCATGCTATGATGGTTGATATCGCCGTTCAATTGGTTCAA<br>AAGTGGGAAAGATTGAACGCCGATGAACATATCGAAGTCTCTGAAGATATGACCA<br>GATTGACCTTGGATACCATTGGTTTGTGTGGTTTCAACTACAGATTCAACTCCTTC<br>TACAGAGATCAACCACATCCATTCATCATCTCTATGGTTAGAGCTGCAGATGAAGT<br>CATGAACAAATTGCAAAGAGCTAATCCAGACGATCCAGCTTATGACGAAAACAAG<br>AGACAATTCCAAGAAGATATCAAGGTCATGAACGATTTGGTCGATAAGATTATCG<br>CTGATAGAAAGGCTAGAGGTGAACAATCTGATGATTTGTTGACCCAAATGTTGAA<br>CGGTAAGGATCCAGAAACTGGTGAACCATTGGATGATGGTAACATCAGATACCAA<br>ATTATCACCTTCTTGATTGCTGGTCACGAAACTACATCTGGTTTGTTGTCYTTTGC<br>CTTGTACTTTTTGGTTAAGAACCCACACGTCTTGCAAAAGGTTGCTGAAGAAGCTG<br>CAAGAGTTTTGGTTGATCCAGTTCCATCTTACAAGCAAGTCAAGCAATTGAAGTA<br>CGTTGGTATGGTTTTGAACGAAGCTTTGAGATTGTGGCCAACTGCTCCAGCTTTTT<br>CATTATACGCTAAAGAAGATACCGTCTTGGGTGGTAATATCCATTGGAAAAAGG<br>TGATGAAGTTATGGTCTTGATCCCACAATTGCATAGAGATAAGACTGTTTGGGGT<br>GATGATGTCGAAGAATTCAGACCAGAAAGATTCGAAAACCCATCTGCTATTCCAC<br>AACATGCTTTTAAGCCATTTGGTAACGGTCAAAGAGCTTGCATTGGTCAACAATT<br>CGCTTTACATGAAGCTACCTTGGTTTTGGGTATGATGTTGAAACACTTCGACTTCG<br>AAGATCACACCAACTACGAATTGGATATCAAAGAAACCTTGACCTTGAAGCCAAA<br>GGGTTTTGTTGTTAAGGCTAAGTCCAAAAAGATTCCATTGGGTGGTATTCCATCT<br>CCATCTCTACTGAACAATCCGCTAAGAAGGTTAGAAAGAAAGCTGAAAACGCTCATA<br>ACACACCTTTGTTGGTCTTGTACGGTTCTAATATGGGTACTGCTGAAGGTACAGCA<br>AGAGATTTGGCAGATATTGCTATGTCTAAAGGTTTCGCTCCACAAGTTGCTACTTT<br>GGATTCTCATGCTGGTAATTTGCCAAGAGAAGGTGCTGTTTTGATAGTTACTGCT<br>TCTTACAATGGTCACCCACCAGATAATGCTAAGCAATTCGTTGATTGGTTGGATCA<br>AGCTTCAGCTGATGAAGTAAAAGGTGTTAGATACTCTGTTTTCGGTTGCGGTGAC<br>AAAAAATTGGGCTACTACTTATCAAAAGGTTCCAGCCTTTATTGACGAAACTTTGG<br>CTGCTAAAGGTGCTGAAAACATTGCTGACAGAGGTGAAGCTGATGCCTCCGACGA<br>CTTCGAAGGTACTTACGAAGAATGGAGAGAACACATGTGGTCTGACGTTGCTGCT<br>TACTTCAACTTGGACATCGAAAACTCTGAAGACAACAAGTCCACTTTGTCTTTGCA<br>ATTCGTTGACTCCGCTGCTGACATGCCATTGGCTAAGATGCACGGTGCTTTCTCTA<br>CCAACGTCGTTGCCTCCAAGGAATTGCAACAACCAGGTTCTGCTAGATCTACTAGA<br>CACTTGGAAATCGAATTGCCAAAGGAAGCTTCCTACCAAGAAGGTGACCACTTGG<br>GCGTTATTCCAAGAAACTACGAAGGTATCGTCAACAGAGTTACTGCTAGATTCGG<br>TTTGGATGCTTCTCAACAAATCAGATTAGAAGCTGAAGAAGAAAAGTTGGCTCAC<br>TTGCCATTAGCTAAGACTGTCTCCGTTGAAGAATTGTTGCAATACGTCGAATTGCA<br>AGACCCAGTTACCAGAACCCAATTGAGAGCCATGGCTGCCAAGACCGTCTGTCCAC<br>CACACAAGGTTGAATTGGAAGCCTTGTTGGAAAAGCAAGCCTACAAGGAACAAGT<br>TTTGGCTAAGAGATTGACCATGTTGGAATTGTTGGAAAAGTACCCAGCCTGCGAA<br>ATGAAGTTCTCTGAATTTATCGCCTTGTTGCCATCTATCAGACCACGTTACTACTC<br>TATTTCTTCCTCTCCACGTGTTGACGAAAAGCAAGCTTCTATTACTGTTTCCGTTG<br>TCTCCGGTGAAGCTTGGTCCGGTTACGGTGAATACAAGGGTATTGCTTCTAACTAC<br>TTGGCTGAATTGCAAGAAGGTGACACCATTACTTGTTTCATCTCTACTCCACAATC<br>CGAATTTACTTTGCCAAAGGACCCAGAAACTCCATTGATCATGGTTGGTCCAGGTA<br>CTGGTGTCGCTCCATTCAGAGGTTTCGTTCAAGCTAGAAAACAATTGAAGGAACA<br>AGGTCAATCTTTGGGTGAAGCTCACTTGTACTTCGGTTGTAGATCTCCACACGAAG<br>ACTACTTATACCAAGAAGAATTGGAAAACGCTCAATCCGAAGGTATTATCACTTT<br>GCACACCGCTTTCTCCAGAATGCCAAACCAACCAAAGACTTACGTCCAACACGTTA<br>TGGAACAAGACGGTAAGAAGTTGATTGAATTGTTGGACCAAGGTGCTCACTTCTA<br>CATTTGTGGTGATGGTTCTCAAATGGCTCCAGCCGTTGAAGCCACTTTGATGAAGT<br>CTTACGCTGATGTTCACCAAGTTTCCGAAGCCGATGCTAGATTATGGTTGCAACAA<br>TTGGAAGAAAAAGGTCGTTACGCTAAGGATGTCTGGGCCGGTTGA | 144 |

TABLE 7-continued

Variants of BM3 N-demethylase

| 4H5 | ATGACCATCAAAGAAATGCCACAACCTAAGACTTTCGGTGAATTGAAGAATTTGC<br>CTTTGTTGAACACCGATAAGCCAGTTCAAGCTTTGATGAAGATTGCTGATGAATT<br>GGGTGAAATCTTCAAGTTTGAAGCTCCAGGTAGAGTCACTAGATACTTGTCATCTC<br>AAAGATTGATCAAAGAAGCCTGCGACGAATCCAGATTTGATAAGAATTTGTCTCA<br>AGCTGCTAAGTTCGCTAGAGATTTTGCTGGTGATGGTTTGGTTACTTCTTGGACTC<br>ACGAAAAGAATTGGAAGAAGGCCCATAACATTTTGTTGCCATCTTTCTCACAACA<br>AGCCATGAAGGGTTATCATGCTATGATGGTTGATATCGCCGTTCAATTGGTTCAA<br>AAGTGGGAAAGATTGAACGCCGATGAACATATCGAAGTCTCTGAAGATATGACCA<br>GATTGACCTTGGATACCATTGGTTTGTGTGGTTTCAACTACAGATTCAACTCCTTC<br>TACAGAGATCAACCACATCCATTCATCATCTCTGCTGTTAGAGCTGCAGATGAAGT<br>CATGAACAAATTGCAAAGAGCTAATCCAGACGATCCAGCTTATGACGAAAACAAG<br>AGACAATTCCAAGAAGATATCAAGGTCATGAACGATTGGTCGATAAGATTATCG<br>CTGATAGAAAGGCTAGAGGTGAACAATCTGATGATTTGTTGACCCAAATGTTGAA<br>CGGTAAGGATCCAGAAACTGGTGAACCATTGGATGATGGTAACATCAGATACCAA<br>ATTATCACCTTCTTGATTGCTGGTCACGAAACTACATCTGGTTTGTTGTCYTTTGC<br>CTTGTACTTTTGGTTAAGAACCCACACGTCTTGCAAAAGGTTGCTGAAGAAGCTG<br>CAAGAGTTTTGGTTGATCCAGTTCCATCTTACAAGCAAGTCAAGCAATTGAAGTA<br>CGTTGGTATGGTTTTGAACGAAGCTTTGAGATTGTGGCCAACTGCTCCAGCTTTTT<br>CATTATACGCTAAAGAAGATACCGTCTTGGGTGGTGAATATCCATTGGAAAAAGG<br>TGATGAAGTTATGGTCTTGATCCCACAATTGCATAGAGATAAGACTGTTTGGGGT<br>GATGATGTCGAAGAATTCAGACCAGAAAGATTCGAAAACCCATCTGCTATTCCAC<br>AACATGCTTTTAAGCCATTTGGTAACGGTCAAAGAGCTTGCATTGGTCAACAATT<br>CGCTTTACATGAAGCTACCTTGGTTTTGGGTATGATGTTGAAACACTTCGACTTCG<br>AAGATCACACCAACTACGAATTGGATATCAAAGAAACCTTGACCTTGAAGCCAAA<br>GGGTTTTGTTGTTAAGGCTAAGTCCAAAAAGATTCCATTGGGTGGTATTCCATCT<br>CCATCTACTGAACAATCCGCTAAGAAGGTTAGAAAGAAAGCTGAAAACGCTCATA<br>ACACACCTTTGTTGGTCTTGTACGGTTCTAATATGGGTACTGCTGAAGGTACAGCA<br>AGAGATTTGGCAGATATTGCTATGTCTAAAGGTTTCGCTCCACAAGTTGCTACTTT<br>GGATTCTCATGCTGGTAATTTGCCAAGAGAAGGTGCTGTTTTGATAGTTACTGCT<br>TCTTACAATGGTCACCCACCAGATAATGCTAAGCAATTCGTTGATTGGTTGGATCA<br>AGCTTCAGCTGATGAAGTAAAAGGTGTTAGATACTCTGTTTTCGGTTGCGGTGAC<br>AAAAAATTGGGCTACTACTTATCAAAAGGTTCCAGCCTTTATTGACGAAACTTTGG<br>CTGCTAAAGGTGCTGAAAACATTGCTGACAGAGGTGAAGCTGATGCCTCCGACGA<br>CTTCGAAGGTACTTACGAAGAATGGAGAGAACACATGTGGTCTGACGTTGCTGCT<br>TACTTCAACTTGGACATCGAAAACTCTGAAGACAACAAGTCCACTTTGTCTTTGCA<br>ATTCGTTGACTCCGCTGCTGACATGCCATTGGCTAAGATGCACGGTGCTTTCTCTA<br>CCAACGTCGTTGCCTCCAAGGAATTGCAACAACCAGGTTCTGCTAGATCTACTAGA<br>CACTTGGAAATCGAATTGCAAAGGAAGCTTCCTACCAAGAAGGTGACCACTTGG<br>GCGTTATTCCAAGAAACTACGAAGGTATCGTCAACAGAGTTACTGCTAGATTCGG<br>TTTGGATGCTTCTCAACAAATCAGATTAGAAGCTGAAGAAGAAAAGTTGGCTCAC<br>TTGCCATTAGCTAAGACTGTCTCCGTTGAAGAATTGTTGCAATACGTCGAATTGCA<br>AGACCCAGTTACCAGAACCCAATTGAGAGCCATGGCTGCCAAGACCGTCTGTCCAC<br>CACACAAGGTTGAATTGGAAGCCTTGTTGAAAAGCAAGCCTACAAGGAACAAGT<br>TTTGGCTAAGAGATTGACCATGTTGGAATTGTTGGAAAAGTACCCAGCCTGCGAA<br>ATGAAGTTCTCTGAATTTATCGCCTTGTTGCCATCTATCAGACCACGTTACTACTC<br>TATTTCTTCCTCTCCACGTGTTGACGAAAAGCAAGCTTCTATTACTGTTTCCGTTG<br>TCTCCGGTGAAGCTTGGTCCGGTTACGGTGAATACAAGGGTATTGCTTCTAACTAC<br>TTGGCTGAATTGCAAGAAGGTGACACCATTACTTGTTTCATCTCTACTCCACAATC<br>CGAATTTACTTTGCCAAAGGACCCAGAAACTCCATTGATCATGGTTGGTCCAGGTA<br>CTGGTGTCGCTCCATTCAGAGGTTTCGTTCAAGCTAGAAAACAATTGAAGGAACA<br>AGGTCAATCTTTGGGTGAAGCTCACTTGTACTTCGGTTGTAGATCTCCACACGAAG<br>ACTACTTATACCAAGAAGAATTGGAAAACGCTCAATCCGAAGGTATTATCACTTTT<br>GCACACCGCTTTCTCCAGAATGCCAAACCAACCAAAGACTTACGTCCAACACGTTA<br>TGGAACAAGACGGTAAGAAGTTGATTGAATTGTTGGACCAAGGTGCTCACTTCTA<br>CATTTGTGGTGATGGTTCTCAAATGGCTCCAGCCGTTGAAGCCACTTTGATGAAGT<br>CTTACGCTGATGTTCACCAAGTTTCCGAAGCCGATGCTAGATTATGGTTGCAACAA<br>TTGGAAGAAAAAGGTCGTTACGCTAAGGATGTCTGGGCCGGTTGA | 145 |
| 7A1 | ATGACCATCAAAGAAATGCCACAACCTAAGACTTTCGGTGAATTGAAGAATTTGC<br>CTTTGTTGAACACCGATAAGCCAGTTCAAGCTTTGATGAAGATTGCTGATGAATT<br>GGGTGAAATCTTCAAGTTTGAAGCTCCAGGTAGAGTCACTAGATACTTGTCATCTC<br>AAAGATTGATCAAAGAAGCCTGCGACGAATCCAGATTTGATAAGAATTTGTCTCA<br>AGCTGCTAAGTTCGCTAGAGATTTTGCTGGTGATGGTTTGGTTACTTCTTGGACTC<br>ACGAAAAGAATTGGAAGAAGGCCCATAACATTTTGTTGCCATCTTTCTCACAACA<br>AGCCATGAAGGGTTATCATGCTATGATGGTTGATATCGCCGTTCAATTGGTTCAA<br>AAGTGGGAAAGATTGAACGCCGATGAACATATCGAAGTCTCTGAAGATATGACCA<br>GATTGACCTTGGATACCATTGGTTTGTGTGGTTTCAACTACAGATTCAACTCCTTC<br>TACAGAGATCAACCACATCCATTCATCATCTCTGCTGTTAGAGCTGCAGATGAAGT<br>CATGAACAAATTGCAAAGAGCTAATCCAGACGATCCAGCTTATGACGAAAACAAG<br>AGACAATTCCAAGAAGATATCAAGGTCATGAACGATTGGTCGATAAGATTATCG<br>CTGATAGAAAGGCTAGAGGTGAACAATCTGATGATTTGTTGACCCAAATGTTGAA<br>CGGTAAGGATCCAGAAACTGGTGAACCATTGGATGATGGTAACATCAGATACCAA<br>ATTATCGCTTTCTTGATTGCTGGTCACGAAACTACATCTGGTTTGTTGTCTTTGC<br>CTTGTACTTTTGGTTAAGAACCCACACGTCTTGCAAAAGGTTGCTGAAGAAGCTG<br>CAAGAGTTTTGGTTGATCCAGTTCCATCTTACAAGCAAGTCAAGCAATTGAAGTA<br>CGTTGGTATGGTTTTGAACGAAGCTTTGAGATTGTGGCCAACTGCTCCAGCTTTTT<br>CATTATACGCTAAAGAAGATACCGTCTTGGGTGGTGAATATCCATTGGAAAAAGG<br>TGATGAAGTTATGGTCTTGATCCCACAATTGCATAGAGATAAGACTGTTTGGGGT | 146 |

TABLE 7-continued

Variants of BM3 N-demethylase

```
GATGATGTCGAAGAATTCAGACCAGAAAGATTCGAAAACCCATCTGCTATTCCAC
AACATGCTTTTAAGCCATTTGGTAACGGTCAAAGAGCTTGCATTGGTCAACAATT
CGCTTTACATGAAGCTACCTTGGTTTTGGGTATGATGTTGAAACACTTCGACTTCG
AAGATCACACCAACTACGAATTGGATATCAAAGAAACCTTGACCTTGAAGCCAAA
GGGTTTTGTTGTTAAGGCTAAGTCCAAAAAGATTCCATTGGGTGGTATTCCATCT
CCATCTACTGAACAATCCGCTAAGAAGGTTAGAAAGAAAGCTGAAAACGCTCATA
ACACACCTTTGTTGGTCTTGTACGGTTCTAATATGGGTACTGCTGAAGGTACAGCA
AGAGATTTGGCAGATATTGCTATGTCTAAAGGTTTCGCTCCACAAGTTGCTACTTT
GGATTCTCATGCTGGTAATTTGCCAAGAGAAGGTGCTGTTTTGATAGTTACTGCT
TCTTACAATGGTCACCCACCAGATAATGCTAAGCAATTCGTTGATTGGTTGGATCA
AGCTTCAGCTGATGAAGTAAAAGGTGTTAGATACTCTGTTTTCGGTTGCGGTGAC
AAAAATTGGGCTACTACTTATCAAAAGGTTCCAGCCTTTATTGACGAAACTTTGG
CTGCTAAAGGTGCTGAAAACATTGCTGACAGAGGTGAAGCTGATGCCTCCGACGA
CTTCGAAGGTACTTACGAAGAATGGAGAGAACACATGTGGTCTGACGTTGCTGCT
TACTTCAACTTGGACATCGAAAACTCTGAAGACAACAAGTCCACTTTGTCTTTGCA
ATTCGTTGACTCCGCTGCTGACATGCCATTGGCTAAGATGCACGGTGCTTTCTCTA
CCAACGTCGTTGCCTCCAAGGAATTGCAACAACCAGGTTCTGCTAGATCTACTAGA
CACTTGGAAATCGAATTGCCAAAGGAAGCTTCCTACCAAGAAGGTGACCACTTGG
GCGTTATTCCAAGAAACTACGAAGGTATCGTCAACAGAGTTACTGCTAGATTCGG
TTTGGATGCTTCTCAACAAATCAGATTAGAAGCTGAAGAAGAAAAGTTGGCTCAC
TTGCCATTAGCTAAGACTGTCTCCGTTGAAGAATTGTTGCAATACGTCGAATTGCA
AGACCCAGTTACCAGAACCCAATTGAGAGCCATGGCTGCCAAGACCGTCTGTCCAC
CACACAAGGTTGAATTGGAAGCCTTGTTGGAAAAGCAAGCCTACAAGGAACAAGT
TTTGGCTAAGAGATTGACCATGTTGGAATTGTTGGAAAAGTACCCAGCCTGCGAA
ATGAAGTTCTCTGAATTTATCGCCTTGTTGCCATCTATCAGACCACGTTACTACTC
TATTTCTTCCTCTCCACGTGTTGACGAAAAGCAAGCTTCTATTACTGTTTCCGTTG
TCTCCGGTGAAGCTTGGTCCGGTTACGGTGAATACAAGGGTATTGCTTCTAACTAC
TTGGCTGAATTGCAAGAAGGTGACACCATTACTTGTTTCATCTCTACTCCACAATC
CGAATTTACTTTGCCAAAGGACCCAGAAACTCCATTGATCATGGTTGGTCCAGGTA
CTGGTGTCGCTCCATTCAGAGGTTTCGTTCAAGCTAGAAAACAATTGAAGGAACA
AGGTCAATCTTTGGGTGAAGCTCACTTGTACTTCGGTTGTAGATCTCCACACGAAG
ACTACTTATACCAAGAAGAATTGGAAAACGCTCAATCCGAAGGTATTATCACTTT
GCACACCGCTTTCTCCAGAATGCCAAACCAACCAAAGACTTACGTCCAACACGTTA
TGGAACAAGACGGTAAGAAGTTGATTGAATTGTTGGACCAAGGTGCTCACTTCTA
CATTTGTGGTGATGGTTCTCAAATGGCTCCAGCCGTTGAAGCCACTTTGATGAAGT
CTTACGCTGATGTTCACCAAGTTTCCGAAGCCGATGCTAGATTATGGTTGCAACAA
TTGGAAGAAAAAGGTCGTTACGCTAAGGATGTCTGGGCCGGTTGA
```

TABLE 8 pA24, pA25, and pA26 sequences

| | | |
|---|---|---|
| pA24 Sequence | cctcgcgcagttaattaaagtcagtgagcgaggaagcgcgtaactataacgtcctaagtgtagcgaatcctgatcgtgtattttcctcctacgcatct<br>gtgcggtatttcacaccgcatagatcgcaagtcgcacaaacaatacttaaatactactccagtactactatttctagcattttgacgaattt<br>gctattttgttagagtcttttacaccgtcttacaccattgctccacctccgcttacacactccggttcttcgggctcctctcctcaacctcctcttgactcaacatctaagcgcatcaacaaccattcttaagcgcatcaaccatttctggc<br>gtcagtccaccagctaactacaataaatgtaagcttcgggctcctgagtttcctcactcaacatcaacaccgctcctccaaccgcagtcagactcgaaatcgagttccaatcgagattccaaagcctgatatgagctcgactgagtgtttcagtcttccaagacgagtcttaaata<br>cctgatctgaactcaaacaaggaactcttggtattcttgccacgactcatctccatgcagtggagccactcaagtattcggagtgccattcctcggtcaacttggactatcaacatgcc<br>actggcaaaccaggaactcttggtattcttgccacgactcatctccatgcagtggagccaatcaagtattcggagtgcctgaacttggactatcaacatgcc<br>gtaatcattgacaggacaaaacatcctccttaagtgattacgaaacacgccaacaagtattcggagtgcctgaacttggactatcaacatgcc<br>agactgaaatttcctgcaacattcgctctctgcagtcaccatataaccgatgcaatctaatcaaccgtgaaattaataatcagagcacatt<br>ctcggccctctgctctcgcaagcgcaaacttcaccaatgacgcagaaactcctgtgaaattaataacagacatactccaagctgcttgtgtgt<br>taatcaagtatactccagtcgccaatgcgctaagtcaccaagtatttcaataaagaatactttccacactcgccactcaatcctctcgaatctgcgtcaaactgcaaagtacaca<br>aagctccggatccagaatcaagttgtaaggtgacacccccgtcatccccgtctaacttacgcgccctcgtctatccttattagttaagcaatcagatccgcatagt<br>tatattacgatcgtgctccttgtttaatgtcctctatatcttcctatctagtcgtattcgtattcgtgtctcgtgcacaatctgcctgatctgatccgcatagt<br>tttgtatttgattttgaaaagtaaaatatcagaatctacgaatttgaaaagtacactgtaaatcaccaggatttcgtgt<br>gcgtacttacacatatatattagacaagaaaagcagattaaatacacattcgattaacgataacatcattcgattaacgatactcgattttcgattttttgcg<br>gtggtctctacacagacaaggtgaaacaaaactgtgcattaaatacctgagagcaggaagagcaagataaaagtagtattgttggcatccctag<br>agtcttttacactctcgaaaacaaaaactattttctttaattcttcttcaatctattttaactttctattttaatttaatcatcaaattaaatatgatcc<br>tttatagcaggatgaaaggaccgataaattgcctcaatacatgtgaaaaaaagagatcttagctatcaatctacgccccgtcaagatcgcctcgtcgcgccctattccctttttgcg<br>gcattgcctcctgttttgctcaccagaaacgctgtgagatgtcgaagataaaagtcaaactcagtgggacgcacgatcagggaccctgtagatctaagagacgacctgtcggtt<br>aatgcctccgctcgtcgtcgctaccaaggttgccgggtgacgtaatgcaagcggtgatgcgcccactgcttcaccaactggtcagcccgtgacaactggtcagacgagagttgatgttgtcagggatctaagtgtcgtcagggacgt<br>cgtaagctgtaatgcaagtagcgtatgctcgcccgtcacgcaactggtcgctcacgcaaggtatgcgtcacgcaggtaaccgccagttgagcagcggtggccagttttcatgg<br>cttgtactggttttttgggtacggctctgccgggcagcgacatcgtttccgtgcgtcaattcgctacgcgtggtacgcgtcacgcaggtaaccgccagttgagcagcaa<br>cgatgttacgcagggagtcgccctcaaaaacaagtaaaacatattagggaaggcagctctttgcgcatctatgggagcgttaggtttgatgttatgcgagttcgtcgcatgattgatgaaaagaagtaagtcgcagggcaagttgctcgagcatcagaggtgcaaatcaagaggagggtcaaggagcg<br>ggcgcctcgacgcctcgcgaacgacgttgcggccgtcacattgtgccgtacgtcagcgcttgatcaacgaccttggaactcggctgcccctcacgctgatcgtcacgatcgcccggtgatcgccgagattcttgatccaacgaccttttggaaactcggcttcccccggagagcgagattc<br>tccggcgtagaagtgcaccattgtgcgacgacatcgtcccggcgctatccgcactcgtatcgcagtttaagctggcagttggagaattggcagcgcaat<br>gacatccttgcagttattcgagccgttgatcgtcgagcctgatcaatctggcatcgtgagctcttgcagctgcttgcagctgcttgcagttgtgcgtcgcgcccgacaccatagcgtgcctggtagtcca<br>gcgcggaggaactcttgatccggttcctgacagtctcctgacagctcgtcgcctatagctggagcgtcagctccgatgacaactccgcgaaggatgttctgttgctcgcgcgtccgactggctgg<br>cgatgaggacgaaattgaacgcgtagtagtcgctcccgcattggtgaggcctagcaggcggtacgcgggcgcgtcaactccgcgaaggatgtcgcgcctgactgctccggactgctgcgcgcgtccgactggctggg<br>gagcgcctcgccagtacgcagcccgtaccgtcgaatccgcgggtgcaactgcgcaactaccagctgatcctcacgcaggaagatcggtgttgcgtcgcgcgtacgcgtagtcgcagatcagt<br>tggaagaattgtccaactacgtgaaagcgagatgattccagtcgagtcagtttatttgcctccggcatcaggccagaggccctgattattgacgtgttg<br>atggccccctaacctctattgtgcaaaaaatagctcctttgaaagaatcgtctccgctgaaccgctctgctacaacctcaagaataccttcaagaataccgcggtacacagaatatatatacacgt<br>ttcctaacttatttgtgcaaaaataagactcctttaattctgctgaaccgtactgcctgaaactcaagaataccgcggtacacagaatatatataacacgt<br>agtagctcgggtgaacactctattcctgacatcctgcatcatccaatctattaatgagcgcctgaaactcaagaataccgcgcttgccgcttaagctggccgcttaagctggcaacttggcaacttaaaacaccaa<br>aatattgcttcttccaccacagtcactgacaaggtcctgttcatagggtcagcatcaagggtagccctatatgacagggcaaagctggccgcttaagcaacctccagcgaaactagtagcctccgctcaagcttcttcaagcttcaagcttcttaagcttctcactgggtattcaacctctccattgaccctatattctgctactgaccctataagcaactaccctttatctcagccatctggtaattcttaaatagttcttaaaccaactcttagcaagttttttcaaattttttttttc<br>caatggagtgatgcaactgcctgagtcaactgcctgagtaaatgatgacaaggcaattgacaaggcaattgaccaaggcaattccctgcaagcttcatccttctggaaagggctatttcttcatttcaagttaacacctctattacttctgct<br>tgtacaaccgcctaccatgaacattatactgaaaacctgcttgaaagtttcggttcttcgctaagagaacttcatttgcgttccgtccttatacactttac<br>ggttccctctccgtgcctaccatgagcacagatttacgaaggtatcagagacctctgatcttatgaaaattctcggttcttcgccttatggcgttccgttcctcttcgtc<br>gagcccgtctccgtgaccaccgtgcctaccagccaccgcgcgcttgacgccaacactgaaaactgagacggcgcaatctgagaaagatcaaggtgaacactagtgaagatcct<br>ataacttaatgttttattaaacctacgcgtgcaaccgcaccaaacactccgctaagctggcctcaagcgcaccaactgtacactgttccgaagtaac<br>tttgataatctcatgaccacaaaatacccttaacgtgagtttttgtcctggtttcgcactgagctgtgttttgcggatcagaacaactgtcagagctctaaccgaa<br>tcgcgcgtaacgtcagcagcgagatccgcacagcgacatatcctcttcacagcagcagtaccaccgcctgaccacctctcagagccagagactcgagcacactgagctgactggcgcgatgagctgaattatttttacagtggctgctcagctgtgcctccgcttctttttcgctagatccttt<br>tggcttcagcagcgcagatccgcagatacaactgcctttcaattcctgctatagcgcctagtgtaggccgtagttacggctctacggtaggagccttaagtctcgaagtaac | SEQ ID NO: 147 |

TABLE 8-continued pA24, pA25, and pA26 sequences

| | | |
|---|---|---|
| pA25 sequence | aacgaccaccaccgaactgagatacctacagcgtgagctgagtatgagaaagcgcacgctcccgaagggagaaaggcggacaggtatccggtaagcg<br>gcaggtcgaacggagacgcgcgaggagagctccagggagaagctccgtctatctttatagtcctgcgggtttcgccactcgtactttgagcg<br>tcgattttgtgatgctcgtcaggggcggagcctatggaaaaccgcagttgaacgtgcattatgaattacgctaggat<br>aacagggtaatatagaaccgaacgaccgagccgagcgggcgggacgccgctgataccgcgcctgcgcagtcagtcagtgagcgagga<br>agcgcgtaactataacgctccctaagtgtagcggaatcgtgcagtgcagtctctcctagcactctgtcgcgttatttcacaccgcatagatcggcaagtgc<br>acaaacatactactaaataacctactaacctattctttacgaagtctttagtcttagtcttacgtctctacgcccattttgctctccac<br>acctccgctacatcaacaccaataacgccattttaatcgaagcatctctgccgctgtcagtccacaactttctgcggtcagtccaccagtaacataaatgtaagcttc<br>gggctcctcgcctccaaccagtcagaacgacgatccactccaaaagtcaccactgtccaccctgtctgaatcaacaaggaataaacgaat<br>gggtttctgtgaagctgcactgagtgatgtgcagtcttggaaatacgagtctttggaaatacgaggaactctggtattcttgcca<br>cgactcatcccagtgagtcgcaaatcatccgggtcggcaatatcaatgcgtaatcattgacgagccaaaacatccctaa<br>gttgattacgaaacgcaaccaagtattccggagttcggagttgcctgagtcagacaatactatttttatgcttctacaagactgaaattccctgcaataaccggtcaatt<br>gtctctttctattggcacacatactggtgaatataacagacatactccaagctgcttgtgcttaatccctgtataccacgtgctcaatagtcaccaat<br>ccaatgccccagaactcctttctcgagcggtaccgaattaattcttaactggcaaaaaaagtccgatcaagattgtacgtaaggtgaca<br>agctattttcaataagaatactcttccactactgcgtcacatctgcgtcaatctgctctgagtacaagtacacatattacgatcgtgtctattaatgttcctatat<br>tatatatagtaatgtcgtgatctatggtgcactctcagtacaacagcagtgcacctcgggagctgtgcagaggtttcaccgtcaccac<br>acgccctgacgggctcctgctccccgagctcgcctgcaacagttcactgatcgcagcagtatattggctctgccctgataacaagttggcatgtgccggtgtgcctgtaacttta<br>cgaaacgcgcagacgaaaggctcgtgatacgcctcttttatgggaattacctcgtgttattatttcgttgattttggaaatcagaagtaatagaagagt<br>cacgcgccgtctcttttaatgggagatatgcgctcaccaaaaaataaacaaaggttttttaaaaaaatctcaaacaaaagtaaaaagctactttaataaaaaagctactaaagaaag<br>cgagttaaatacctgagagcaggaagcaagataaagtaagttgttgcgatcccctcagagtctttcaactcctcggaaaacaaaactatttttt<br>cttaattctttctttacttctcattttaatttatcatatataaaaaatttaaatataattatttataccgcataagaacacgtgatgaaagaccccaggtggca<br>ctttcgggaaatgtgcggaacccatttctttatttcaatcatctttccgctcagatgtatccgcatttgcctttcgtgtcctgcaccaaggttcctcaccaaggtgcg<br>taatattgaaaaggaagatgctgaagatcagtttggaacgtagctcagaccagaaatcctgtcaacatcgggctgagacaacagagacatgcctgactctgcgactgtcgcac<br>cggtgaaacacccgagacagacctcgtaagcgacaaccgttctggtcgaatgcctaagcgcatgctcaggacgtgtcgtaacatgcgcac<br>gcaactggcccagaaccttgacgaccggacgcaagcgagcagcacctcgatgttgtcgctacgacggcgtcagcagcatctgcgatgctcaaaac<br>ctcgggcatccaagcacgagcgtacgcctggccggaagtcgccgaagtatcgacctcactcacgagtttcggcagtgcgtacgcagcgagcgagttg<br>aagttaaaacatattagggaaggcggtagcgccagtccgaggtatccgaattgggaaaatcagaagtcggcgcgagcgcatctcgagcgagttg<br>ctgccgacatttagccgtctcgcagcgccaaggcgcacagtgattgattcggtacgttaggaggcttgataagc<br>aaccggcgagtctcgtccgccacagaccctttggaacttggaacgtcctcctcggcgttgaagcgagactcccggccctgagtactctgccactcaagttgtgcacg<br>acgacatttccgcgcttcccgctaagcgagacaagcaacatacaagatcgtcgtgtaggccacgcggcgatgagccaaaatgttcctcggttcctga<br>acaggctatattgaggctacaatgaactttaacgctggactcgcccgactggctggcccgcggtgagcgaaatgttagtcctggtccgtactc<br>gcatttggacacgcaagcgaacggcaagccaaatccgccgaagagatcgtcgctgcgcctgatagagcgccatagcgcccgatctcaagcgtg<br>tacttgaagctgacaggctttatctttgaacaggcaaatacccgagcattcaaggcgccttgattattttacgtggtctcacgaggctagcctgatgtagatg<br>gatcaccaagggtgtgggtggtgatcaacggccccacgtggcataagacctcgacagatccgcaggggtatatatagccgttagtg<br>ctgacacacacagcatatatgtgcgcaaacacatgcatctatatgcacgccctccccccctcaaccgaaaaggaagtagacaacctg<br>aatttttccttatacattaggaccttgccgcatcatactactccattccacgccctccctccaccgccctcaaccgaaaaggaagtagacaacctg<br>ttttccttgtcgtcatatttattttaatgtcgtaatcgttgttagttatttttttcctgtacaacgttacgcatgtaa<br>aagtctaggtcctatttatttgaagtttgggacgtcgaggttttgggcgctcagaagcttaattgtaatcattaccttcacttatgcgtgatccgacagt<br>cattaactactgaaaacctgcctgagaaggtttgggacgctcagaagcttaattgtaatcattaccttcacttatgcgtgatccgacagt | SEQ ID NO: 148 |

TABLE 8-continued pA24, pA25, and pA26 sequences

| pA26 sequence | acgacctacaccgaactagatacctcagcgtgagctatgagaaagcgccacgcttccgaaggagaaagcggacaggtatccgtaagcgg | SEQ ID NO: 149 |
|---|---|---|

```
tacgggggcggcgacctcgcgggtttcgtcattatgaaatttccggttcaaggcgttccgttctttcttcgtcataacttaatgttttattaaaatac
ctcgcgagtggcaacactgaaatacccagtgagcgggcgtaaccgtcgcacaggatccagtgaagatccttttgataatccatgaccaaatcc
cttaacgtgagtttctgttcccactgacgcgtcagaccctgttgccggatcaaaggatcaaagaatctccttttgagatccttttttctgcgcgtaatctgctgctgcaa
acaaaaaaccaccgctaccaggcggtttgttgcggatcaaagactcaacctcttttccgaaggtaactggcttcagcagagcgcagatacc
aaatactgccttctagatgaccgtagtagccgcactcaagactcttcaagaactggtagctccagccgctaacaccgcctatccgagtggct
gctgccagtggcgataagtcgtgtcttaccgggttggactcaagacgatagttaccggataaggcgcagcggtcgggctgaacggggggttcgtgca
cacagcccagcttggagcg acgacctacaccgaactagatacctcagcgtgagctatgagaaagcgccacgcttccgaaggagaaagcggacaggtatccgtaagcgg
cagggtcggaacagagaggcgcacgagggagcttccaggggaaaccgcctgtatcttatagtcctgtcgggtttcgccacctgactgacgt
cgatttgtgatgctcgtcagggggcggaccctatggaaaaaccgcctatggacccgcggcagtgaactgcattatgaattagttacgctaggata
gcgcgtactatagaaccgaccggcgaccgctaaggtagcaagtcctgatgcagctatttcacctcctacgcatgctatttccaccgcactggcttcacccgcagcgcaagtgca
caacataacttaaataatcactcagtaatcagccatttcttagcatttgacgatttgttcaccacattgctctttgtagagtctttacaccattgtctccaca
cctccgttcactactcaccagtggaactcgtcgagtccaaccccattcaattccaaggcatccaaaagtccttgtcccaccctgcttctctgaatcaaaacaaggagagataaacgaatg
agttttctgacagtctgacagtagtaagtctggcatgtgcagtctttggaaatacgagtctttaataacgaggaacctcttgagtattcttgccac
gaccatcccatgcagtggagccaatcaattcttgcgtcgtcaactttggacgatcaatgccgtaatcattgaccagtccaaaactcccttaag
ttgattacgaaacacgccaacaagtattccgagtgcctgaactatttcagggttttatgtcttacaagactttaaaattttcctgcaatacccggtcaattg
tctcttctcattgggacacatatacccagcagccaagtcctcgaatctaggacagcatctggccctcgtcctgcagccgcaaacttcac
caatgacgaactcctgtgaaattaataacgagactactccaagtcttgcagagcctgtcttaatcacgtatacctcttgatatagtcaccaatg
cctctcgcttggcctctccttctttcctgaccgaattaattctaactgcgtcataactgcaaagtacacatatattacgatgtgttctattaaatgttcctatatt
gctattttcaataagtaatatctttccactactgctatgtgcactctcagtacaatctgctcgatgcgcaataagtcagcgccgaccctgacacaccgtga
atatatagtaatgtcgatctgaatcgcttctctgtcccgcatccagtcgatcatctgctgacaagttcggcatgcgtcggagcgtcatgggttttcaccgtcatccc
cgcgcctgagggtctcgtgctccccgcatccgtatccgcccatctaatttatagggaattcatcataaactgttctagacgagctgcgtgcaacttac
gaacgcgcagacgaaaggcgtatccgacccgtataactttgaatttgggaattcacctcgtgtttattattttgattttagaaagtaaatggagt
agaagagtacggatggaatgaaaaaaaataacaaaggttaaaaattcaaacaaagcgtacttacatatattattagacaagaag
cgattaaatagtatacttcgattaacgataagtaaggtgaaaatgcaagatttcgtgtgtgtcttcaccacagccaagtgaaacaattcgg
cataataccgagacgcagaagcaagcaatgacaagagaatactcccagtctttcactcttgaagaacaaaaactatttttt
cttaattcttttttttacttctattttatatttctaaatacattcaaatatgatcgctcatgagacaataaccctgatgaatgttctcaccagaacg
cttctcgggaaatgctgcggaaaacctcattgttaatcattccgttcgcctatttccgtctttcggcattttgccttcctgtttttgctcaccagaaacg
ctggtgaaagtaaaagatgctgaagatcagtctggctgttatgagtgcaccagtcagccatcaagctgatattgtgccatcttcaacggttcaa
ctgtagtgagtagtgttgggtgcacgagtggttacatcgaactggatctcaacagcggtaagatccttgagagttttcgccccgaagaacgttttcca
atgatgagcacatttaaagttctgctatgtggcgcggtattatcccgtattgacgccgggcaagagcaactcggtcgccgcatacactattct
cagaatgacttggttgagtactcaccagtcacagaaaagcatcttacggatggcatgacagtaagagaattatgcagtgctgccataaccatgagtgataa
cactgcggccaacttacttctgacaacgatcggaggaccgaaggagctaaccgcttttttgcacaacatgggggatcatgtaactcgccttgat
cgttgggaaccggagctgaatgaagccataccaaacgacgagcgtgacaccacgatgcctgtagcaatggcaacaacgttgcgcaaactattt
actggatggaggcggataaagttgcaggaccacttctgcgctcggccttccggctggctggtttattgctgataaatctggagccggtgagcgtgggtctc
gcggtatcattgcagcactggggccagatggtaagccctcccgtatcgtagttatctacacgacggggagtcaggcaactatggatgaacg
aaatagacagatcgctgagataggtgcctcactgattaagcattggtaactgtcagaccaagtttactcatatatactttagattgatttaaa
acttcatttttaatttaaaaggatctaggtgaagatcctttttgataatctcatgaccaaaaatcccttaacgtgagttttcgttccactgagcgtca
gaccccgtagaaagtatcaaaagctcaacctttgtccccgctctccgcgtatgctaccaactctttttccgaaggtaactggcttcagcagagcg
cagataccaaatactgtccttctagtgtagccgtagttaggccaccacttcaagaactctgtagcaccgcctacatacctcgctctgctaatcctgttaccagtgg
ctgctgccagtggcgataagtcgtgtcttaccggggttggactcaagacgatagttaccggataaggcgcagcggtcgggctgaacggggggttcgtgca
cacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacaggtaagagtgtcactcgcttagacctgttccaagaagccacgagccag
tagacaaatctgcttatcgtgcgtctttgacagctccgaagtactcaaggcaggtttcagctctttcatatgctctggaaagccgcagccac
atgaccattcattcgtcggcgctgaagtggtgcttaccctttgttacaactgacgagtgcatcattgatgagcgaaatgtaacagtatcactcgga
acaggatcgtttgagggctaacgtggaaatgagccgcaaaatgccgcccgtgcgcctcctgccggtgctgcaagatgaaactccgagatttccgtcc
gcatttgtacgcgctcttccaagaaaaaggtataactagcgcaaaatccgagatatatgcaatgctttttcacccatgtgcagcttttgcactggaaacgcgg
tactcaagctgactcagggcgtatctgacaaaacccagggcttcaaggtgatccacgacgtgatgcctgagaggcaggcttgatatgtagtg
gatcaccaagtagtcgcaaattaacccctgagcttgaaagccgtcttcaggctgattattgcgccacacgtttgatgcctccgttcctga
actcgttcaacaattcaggccctgctcgttttatttgctttgctcttgcttacattgctctgtgaatttgctgagactcctgtcttcttgcttgctcactgcctacgacgttg
tggaaaagcgtctcctcaaagaaatgcagaaatcgccgaaacatccgcgaaaacttccagataagaccaagcttacgcttacgttcc
aatactaagactgaaactcggatcgttcatttcacatcacttcacactgacaaaagaataatcacacactcacatgctttcaatcatgtaaa
taataaaacatcaagaacaagcttaatcttgtctttcctagaaaagataaccaaaaaagtttttaattttaatcaaaaaca
ggccccctttcctcacgccacgcttcactcacgccgcccccacatccgctaaccgaagttagac
```

TABLE 8-continued pA24, pA25, and pA26 sequences aacctgaagtctaggtcctattattttttatagttatgttagtattaagaacgttattatatttcttttttctgtacaaacgcgtacg
catgtaacattactgaaaacctgcttgagaagtttggacgctcgaaggcttaattgtaatcattatcacttacggtccttccggtgatcc
gacaggttacggggcggcgacctcgcgggtttcgctatttatgaaaatttccggttaaggcgttccgtctcttcgtcataactaatgttttattt
aaatacctcggagtggcaaactgaaaataccccatggagcggctaaccgtcgcacaggatctagtgaagatctagtgaagatctttgataatctcatgacc
aaatccctaacgtgagttttcgttccactgagcgtcagaccccgtagaaaagatcaaagatcttctgagatcctttttctgcgcgtaatctgctg
cttgcaaacaaaaaccacgctaccagcggtggttgttgccgatcaagagctaccaactcttttccgaagtaactggctcagcagagcgc
agataccaaatactgtcctctcagtgagcgtagtgccgtaggcaccacttcaagaacctgtagcaccgcctacatacctgctctgctaatcctgttacc
agtggctgctgccagtggcgataagtcgtgtcttaccgggttggacttcaagacgatagtaccggataaggcgcagcggtcgggctgaacggggg
ttcgtgcacacagcccagcttggagcga

TABLE 9

Tailoring enzymes

| Reaction Catalyzed | Enzyme | Species |
|---|---|---|
| Carbon-carbon coupling | Berberine bridge enzyme (BBE) | Ps, Ec, Cj, Bs, Tf |
| | Salutaridine synthase (SalSyn) | Ps |
| | Corytuberine synthase (CorSyn) | Cj |
| Oxidation | Tetrahydroprotoberberine oxidase (STOX) | Cj, Am, Bw |
| | Dihydrobenzophenanthridine oxidase (DBOX) | Ps |
| | Methylstylopine hydroxylase (MSH) | Ps |
| | Protopine 6-hydroxylase (P6H) | Ps, Ec |
| Methylenedioxy bridge formation | Stylopine synthase (StySyn) | Ps, Ec, Am |
| | Cheilanthifoline synthase (CheSyn) | Ps, Ee, Am |
| | Canadine synthase (CAS) | Tf, Cc |
| O-methylation | Norcoclaurine 6-O-methyltransferase (6OMT) | Ps, Tf, Cj, Pb |
| | 3'hydoxy-N-methylcoclaurine 4'-O-methyltransferase (4'OMT) | Ps, Tf, Cj, Cc |
| | Raticuline 7-O-methyltransferase (7OMT) | Ps, Ec |
| | Scoulerine 9-O-methyltransferase (9OMT) | Rs, Tf, Cj, Cc |
| N-methylation | Coclaurine N-methyltransferase (CNMT) | Ps, Tf, Cj |
| | Tetrahydroprotoberberine N-methyltransferase (TMNT) | Ps, Ec, Pb |
| O-demethylation | Thebaine demethylase (T6ODM) | Ps |
| | Codeine demethylase (CODM) | Ps, Ga |
| Reduction | Salutaridine reductase (SalR) | Ps, Pb, Ga |
| | Codeinone reductase (COR) | Ps |
| | Sanguinarine reductase (SanR) | Ec |
| Acetylation | Salutaridine acetyltransferase (SalAT) | Ps |

TABLE 10

Comparison of impurities that may be present in concentrate of poppy straw and clarified yeast culture medium.

| | Impurities | Concentrate of Poppy Straw | Classified Yeast Culture Medium |
|---|---|---|---|
| Inorganic | Sodium | ✓ | ✓ |
| | Magnesium | ✓ | ✓ |
| | Silicon | ✓ | x (not in culture medium) |
| | Phosphorus | ✓ | ✓ |
| | Sulfur | ✓ | ✓ |
| | Chloride | ✓ | ✓ |
| | Potassium | ✓ | ✓ |
| | Calcium | ✓ | ✓ |
| | Copper | ✓ | ✓ |
| | Zinc | ✓ | ✓ |
| | Molybdenum | ✓ | ✓ (sodium molybdate in medium) |
| | Iron | ✓ | ✓ |
| | Manganese | ✓ | ✓ |
| | Ammonium | ✓ | ✓ |
| | Boron | ✓ | ✓ |
| Organic | Polysaccharides (starch, cellulose, xylan) | ✓ | x (yeast fed simple sugars) |
| | Lignin (p-coumaryl, coniferyl, sinapyl alcohols) | ✓ | x |
| | Pigments (chlorophyll, anthocyanins, carotenoids) | ✓ | x |
| | Flavonoids | ✓ | x |
| | Phenanthroids | ✓ | x |
| | Latex, gum, and wax | ✓ | x |
| | Rubisco | ✓ | x |
| | Meconic acid | ✓ | x |
| | Pseudomorphine | ✓ | x |
| | Narcaine | ✓ | x |
| | Thebaol | ✓ | x |
| Other | Pesticides, Fungicides | ✓ | x |
| | Herbicides | | |
| | Pollen | ✓ | x |

TABLE 11

Distinct groups of molecules present in clarified yeast culture medium (CYCM). Unlike concentrate of poppy straw (CPS), yeast host strains may be engineered to produce molecules of a predetermined class of alkaloids (i.e., only one biosynthesis pathway per strain) such that other classes of alkaloids are not present. Therefore, the CYCM may contain molecules within a single biosynthesis pathway including a subset of molecules spanning one or two columns, whereas the CPS may contain a subset of molecules across many columns.

| 1-Benzylisoquinoline | Protoberberine and Phthalide isoquinoline | Morphinan | Isoptovine | Aporphine | BisBIA |
|---|---|---|---|---|---|
| Tetrahydropapaverine | Scoulerine | Salutaridine | Pavine | Magnoflorine | Dauricine |
| Dihydropapaverine | Chelanthifoline | Salutaridinol | Caryachine | Corytuberine | Berbamunine |
| Papaverine | Stylopine | Salutaridine-7-O-acetate | Bisnorargemonine | Apomorphine | Ligensinine |
|  | Cis-N-methylstylopine | Thebaine | Isonoraremonine | Boldine | Fangchinoline |
|  | Protopine | Codeinone |  |  | Tetrandrine |
|  | Dihydrosanguiarine | Oripavine |  |  | Curine |
|  | Sanguinarine | Morphinone |  |  | Cepharanthine |
|  | Tetrahydrocolumbamine | Neopinone |  |  | Berbamine |
|  | Canadine | Neopine |  |  |  |
|  | N-methylcanadine | Codeine |  |  |  |
|  | Noscapine | Morphine |  |  |  |
|  | Berberine | Neomorphine |  |  |  |
|  | Narcotoline | Hydrocodone |  |  |  |
|  | Narcotinehemiacetal | Oxycodone |  |  |  |
|  | Narcotolinehemiacetal | 14-hydroxycodeinone |  |  |  |
|  |  | 14-hydroxycodeine |  |  |  |
|  |  | Dihydromorphine |  |  |  |
|  |  | Dihydrocodeine |  |  |  |
|  |  | Oxymorphone |  |  |  |
|  |  | Hydromorphone |  |  |  |

TABLE 12

Impurities that may be present in chemical synthesis preparations of compounds

| Compound | Impurities |
|---|---|
| Buprenorphine | 15,16-Dehydrobuprenorphine, 17,18-Dehydrobuprenorphine, 18,19-demethylbuprenorphine, 19,19'-Ethylbuprenorphine, 2,2'-Bisbuprenorphine, 3-Deshydroxybuprenorphine, 3-O-Methylbuprenorphine, 3-O-Methyl-N-cyanonorbuprenorphine, 3-O-Methyl-N-methylnorbuprenorphine, 6-O-Desmethylbuprenorphine, Buprenorphine N-oxide, N-But-3-enylnorbuprenorphine, N-But-3-enylnormethylbuprenorphine, N-Butylnorbuprenorphine, N-Methylbuprenorphine, Norbuprenorphine, Tetramethylfuran buprenorphine |
| Oxymorphone | 1-Bromooxymorphone, 6-Beta oxymorphol, 10-Alpha-hydroxyoxymorphone, 10-Ketooxymorphone, 2,2-Bisoxymorphone, Noroxymorphone, Oxymorphone N-oxide, 10-Hydroxyoxymorphone, 4-Hydroxyoxymorphone, 8-Hydroxyoxymorphone, Hydromorphinol. |
| Naltrexone | 10-Hydroxynaltrexone, 10-Ketonaltrexone, 14-Hydroxy-17-cyclopropylmethylnormorphinone, 2,2'-Bisnaltrexone, 3-Cyclopropylmethylnaltrexone, 3-O-Methylnaltrexone, 8-Hydroxynaltrexone, N-(3-Butenyl)-noroxymorphone, Naltrexone aldol dimer, N-Formyl-noroxymorphone |
| Naloxone | 10-Alpha-hydroxynaloxone, 10-Beta-hydroxynaloxone, 10-Ketonaloxone, 3-O-Allylnaloxone, 7,8-Didehydro-naloxone, 2,2'-Bisnaloxone, Naloxone N-oxide |
| Nalbuphine | Beta-epimer of nalbuphine, 2,2'-Bisnalbuphine, 6-Ketonalbuphine, 10-Ketonalbuphine, Alpha-noroxymorphol, N-(Cyclobutylcarbonyl)-alpha-noroxymorphol, N-Formyl-6-alpha-noroxymophol. |

TABLE 13

Sequenced DRS variants from NeXT shuffling.
Variant Fold Increase

| | | | | | | | | | |
|---|---|---|---|---|---|---|---|---|---|
| Shuffle 1 | P62H5 | 1.638241644 | | | | H69Q | | | |
| | P62B2 | 1.576250752 | | | | | | | M110I (ATT) |
| | P62F2 | 1.538682415 | | | I64V | H69Q | | | M110I (ATT) |
| | P62A2 | 1.460652224 | | | | H69Q | | | |
| | P64B7 | 1.418140103 | V16A | | I64V | H69Q | | | |
| | P64E8 | 1.315439193 | | A17T | I64V | H69Q | | | |
| | P64H5 | 1.275586104 | | A17T | | | | | M110I (ATT) |
| | P67F2 | 1.255716231 | | | | H69Q | | | |
| | P68H4 | 1.2299 | | | I64V | H69Q | | | |
| | P62C7 | 1.573899645 | | S37L | | | V70I | | |
| Shuffle 2 | P62C12 | 1.489962333 | | A50T | | | | N75N | |
| | P62E12 | 1.452912094 | | A50T | | | | | |
| | P63H4 | 1.589339014 | | | | | | | I128V |
| Shuffle 3 | P63G5 | 1.501274453 | | | | | | | |
| | P63D8 | 1.477603489 | | | | | | | M110I (ATT) |

TABLE 13-continued

Sequenced DRS variants from NeXT shuffling.
Variant Fold Increase

| Shuffle | Variant | Fold Increase | | | | | | | | |
|---|---|---|---|---|---|---|---|---|---|---|
| Shuffle 4 | P63E11 | 1.465443715 | | | | | | | | |
| | P63B8 | 1.451299755 | A17T | | | | | | | |
| | P65F4 | 1.276225908 | A17T | | | | | | | |
| | P65G5 | 1.287936309 | | | | | | | M110I (ATT) | |
| | P65C9 | 1.275310331 | A17T | | | | | | | |
| | P67E10 | 1.279753096 | A17T | | | | | | | |
| | P68A11 | 1.284272846 | V16A | | | | | | M110I (ATT) | |
| | P69G10 | 1.440947016 | A17T | | | | | | M110I (ATT) | |
| Shuffle 1 | P62H5 | 1.638241644 | | | | | | | K293M | |
| | P62B2 | 1.576250752 | | | | | | P256P | K293N | |
| | P62F2 | 1.538682415 | | | | | | | | |
| | P62A2 | 1.460652224 | | R160R | | | | | | R303H |
| | P64B7 | 1.418140103 | | | | | V244A | | | |
| | P64E8 | 1.315439193 | | R160R | | | | | K293M | |
| | P64H5 | 1.275586104 | | | | | | | | R303H |
| | P67F2 | 1.255716231 | | | T232A | | | | | |
| | P68H4 | 1.2299 | | | | A234V | | | | |
| | P62C7 | 1.573899645 | | | | | | | K293N | |
| Shuffle 2 | P62C12 | 1.489962333 | | | | | | | | |
| | P62E12 | 1.452912094 | | | | | | | K293N | |
| | P63H4 | 1.589339014 | | | | | | | | |
| Shuffle 3 | P63G5 | 1.501274453 | | | | | | | | |
| | P63D8 | 1.477603489 | | | L191L | | | | | |
| Shuffle 4 | P63E11 | 1.465443715 | Y155H | | | | | | | |
| | P63B8 | 1.451299755 | | | | | | | K293M | |
| | P65F4 | 1.276225908 | Y155H | | | | | | | |
| | P65G5 | 1.287936309 | | | | | | P256P | | |
| | P65C9 | 1.275310331 | Y155H | | | | | | | |
| | P67E10 | 1.279753096 | Y155H | | | | | | | |
| | P68A11 | 1.284272846 | | | | | | P256P | | |
| | P69G10 | 1.440947016 | | | | | | | | |
| Shuffle 1 | P62H5 | 1.638241644 | | | | | | | | |
| | P62B2 | 1.576250752 | | | | | | | | |
| | P62F2 | 1.538682415 | | | | | | E472D | | |
| | P62A2 | 1.460652224 | | | | | | | | |
| | P64B7 | 1.418140103 | | | | | | | | |
| | P64E8 | 1.315439193 | | | | | | | | |
| | P64H5 | 1.275586104 | | | | | | E472D | I500I | |
| | P67F2 | 1.255716231 | | T359T | | | | | | |
| | P68H4 | 1.2299 | | | | | | E472D | | |
| | P62C7 | 1.573899645 | | | | | D393N | | | |
| Shuffle 2 | P62C12 | 1.489962333 | | | | | | | | |
| | P62E12 | 1.452912094 | | | | K387T | D393N | | | |
| | P63H4 | 1.589339014 | | | | | | | | |
| Shuffle 3 | P63G5 | 1.501274453 | | | L366L | | | | | |
| | P63D8 | 1.477603489 | | T359T | | | | | | |
| Shuffle 4 | P63E11 | 1.465443715 | D354G | | | | | | | |
| | P63B8 | 1.451299755 | P328S | T359T | | | | | | |
| | P65F4 | 1.276225908 | | | | | | | | |
| | P65G5 | 1.287936309 | | | | | | | | |
| | P65C9 | 1.275310331 | | | | | | | | |
| | P67E10 | 1.279753096 | | | | | | | D477Y | |
| | P68A11 | 1.284272846 | | | | | | | | |
| | P69G10 | 1.440947016 | | | | | | | | |

Notwithstanding the appended claims, the disclosure set forth herein is also defined by the following clauses:

1. A method of increasing production of an alkaloid product through the epimerization of a (S)-1-benzylisoquinoline alkaloid to a (R)-1-benyzlisoquinoline alkaloid via an engineered split epimerase in an engineered host cell in comparison to the epimerization of a (S)-1-benzylisoquinoline alkaloid to a (R)-1-benyzlisoquinoline alkaloid via a fused epimerase in similar conditions, said method comprising:

contacting said (S)-1-benzylisoquinoline alkaloid with said engineered split epimerase in said engineered host cell, thereby increasing production of an alkaloid product, wherein contacting said (S)-1-benzylisoquinoline alkaloid with said engineered split epimerase converts said (S)-1-benzylisoquinoline alkaloid to said (R)-1-benzylisoquinoline alkaloid within said engineered host cell.

2. The method of clause 1, wherein said engineered split epimerase comprises an oxidase component and a reductase component.

3. The method of clause 1, wherein said engineered split epimerase comprises one or more mutations that increase activity of said engineered split epimerase.

4. The method of clause 1, wherein said engineered split epimerase comprises one or more mutations selected from the group consisting of a localization mutation, a cytochrome P450 reductase interaction mutation, and an accessibility mutation.

5. The method of clause 2, wherein said oxidase component comprises a sequence that is encoded by a DNA sequence which comprises one or more mutations, each mutation at a codon position which corresponds to a position selected from the group consisting of positions 16, 17, 37, 50, 64, 69, 70, 110, 128, 155, 232, 234, 244, 293, 303, 328, 354, 387, 393, 427, and 477 within SEQ ID NO. 17.

6. The method of clause 2, wherein said oxidase component comprises a sequence that is at least 80% homologous to SEQ ID NO. 17.

7. The method of clause 2, wherein said oxidase component comprises a sequence that is at least 85% homologous to SEQ ID NO. 17.

8. The method of clause 2, wherein said oxidase component comprises a sequence that is at least 90% homologous to SEQ ID NO. 17.

9. The method of clause 2, wherein said oxidase component comprises a sequence that is at least 95% homologous to SEQ ID NO. 17.

10. The method of clause 6, wherein said oxidase component comprises a sequence that is encoded by a DNA sequence which comprises one or more codon substitutions, relative to a wildtype sequence, at a codon position which corresponds to an amino acid position in SEQ ID NO. 17 selected from the group consisting of position 75, 160, 191, 256, 359, 366, and 500.

11. The method of clause 2, wherein said reductase component comprises a sequence that is at least 80% homologous to SEQ ID NO. 18.

12. The method of clause 2, wherein said reductase component comprises a sequence that is at least 85% homologous to SEQ ID NO. 18.

13. The method of clause 2, wherein said reductase component comprises a sequence that is at least 90% homologous to SEQ ID NO. 18.

14. The method of clause 2, wherein said reductase component comprises a sequence that is at least 95% homologous to SEQ ID NO. 18

15. A method of increasing production of an alkaloid product through the epimerization of a (S)-1-benzylisoquinoline alkaloid to a (R)-1-benyzlisoquinoline alkaloid via an engineered split epimerase in an engineered host cell in comparison to the epimerization of a (S)-1-benzylisoquinoline alkaloid to a (R)-1-benyzlisoquinoline alkaloid via a fused epimerase in similar conditions, said method comprising:
contacting said (S)-1-benzylisoquinoline alkaloid with said engineered split epimerase in said engineered host cell, thereby increasing production of an alkaloid product,
wherein contacting said (S)-1-benzylisoquinoline alkaloid with said engineered split epimerase converts said (S)-1-benzylisoquinoline alkaloid to said (R)-1-benzylisoquinoline alkaloid within said engineered host cell, and wherein said engineered split epimerase produces at least 1% more of said (R)-1-benzylisoquinoline alkaloid than a fused epimerase under similar conditions.

16. The method of clause 15, wherein said engineered split epimerase produces at least 3% more of said (R)-1-benzylisoquinoline alkaloid than a wildtype fused epimerase under similar conditions.

17. The method of clause 15, wherein said engineered split epimerase produces at least 5% more of said (R)-1-benzylisoquinoline alkaloid than a wildtype fused epimerase under similar conditions.

18. The method of clause 15, wherein said engineered split epimerase produces at least 10% more of said (R)-1-benzylisoquinoline alkaloid than a wildtype fused epimerase under similar conditions.

19. The method of clause 15, wherein said engineered split epimerase produces at least 15% more of said (R)-1-benzylisoquinoline alkaloid than a wildtype fused epimerase under similar conditions.

20. The method of clause 15, wherein said engineered split epimerase produces at least 20% more of said (R)-1-benzylisoquinoline alkaloid than a wildtype fused epimerase under similar conditions.

21. The method of clause 15, wherein said engineered split epimerase produces at least 25% more of said (R)-1-benzylisoquinoline alkaloid than a wildtype fused epimerase under similar conditions.

22. The method of clause 15, wherein said engineered split epimerase produces at least 30% more of said (R)-1-benzylisoquinoline alkaloid than a wildtype fused epimerase under similar conditions.

23. The method of clause 15, wherein said engineered split epimerase comprises one or more mutations that increase activity of said engineered split epimerase.

24. The method of clause 23, wherein said engineered split epimerase comprises one or more mutations selected from the group consisting of a localization mutation, a cytochrome P450 reductase interaction mutation, and an accessibility mutation.

25. The method of clause 15, wherein said engineered split epimerase comprises an oxidase component and a reductase component.

26. The method of clause 25, wherein said oxidase component comprises a sequence that is at least 80% homologous to SEQ ID NO. 17.

27. The method of clause 25, wherein said oxidase component comprises a sequence that is at least 85% homologous to SEQ ID NO. 17.

28. The method of clause 25, wherein said oxidase component comprises a sequence that is at least 90% homologous to SEQ ID NO. 17.

29. The method of clause 25, wherein said oxidase component comprises a sequence that is at least 95% homologous to SEQ ID NO. 17.

30. The method of clause 25, wherein said oxidase component comprises a sequence that is encoded by a DNA sequence which comprises one or more codon substitutions, relative to a wildtype sequence, at a codon position which is equivalent to an amino acid position in SEQ ID NO. 17 selected from the group consisting of position 75, 160, 191, 256, 359, 366, and 500.

31. The method of clause 25, wherein said reductase component comprises a sequence that is at least 80% homologous to SEQ ID NO. 18.

32. The method of clause 25, wherein said reductase component comprises a sequence that is at least 85% homologous to SEQ ID NO. 18.

33. The method of clause 25, wherein said reductase component comprises a sequence that is at least 90% homologous to SEQ ID NO. 18.

34. The method of clause 25, wherein said reductase component comprises a sequence that is at least 95% homologous to SEQ ID NO. 18.

35. An engineered host cell which comprises an engineered split epimerase, wherein said engineered split epimerase increases conversion of a (S)-1-benzylisoquinoline alkaloid to a (R)-1-benzylisoquinoline alkaloid relative to conversion of a (S)-1-benzylisoquinoline alkaloid to a (R)-1-benzylisoquinoline alkaloid via a fused epimerase under similar conditions.

36. The engineered host cell of clause 35, wherein said engineered split epimerase increases production of said alkaloid product in comparison to an epimerization via a parent fused epimerase under similar conditions.

37. The engineered host cell of clause 35, wherein said engineered split epimerase increases production of said alkaloid product in comparison to an epimerization via a wild-type fused epimerase.

38. The engineered host cell of clause 35, wherein said engineered split epimerase comprises one or more mutations that increase activity of said engineered split epimerase.

39. The engineered host cell of clause 35, wherein said engineered split epimerase comprises one or more mutations selected from the group consisting of a localization mutation, a cytochrome P450 reductase interaction mutation, and an accessibility mutation.

40. The engineered host cell of clause 35, wherein said engineered split epimerase comprises an oxidase component and a reductase component.

41. The engineered host cell of clause 40, wherein said oxidase component comprises a sequence that is encoded by a DNA sequence which comprises one or more mutations, relative to a wildtype sequence, each mutation at a codon position which corresponds to a position selected from the group consisting of positions 16, 17, 37, 50, 64, 69, 70, 110, 128, 155, 232, 234, 244, 293, 303, 328, 354, 387, 393, 427, and 477 within SEQ ID NO. 17.

42. The engineered host cell of clause 40, wherein said oxidase component comprises a sequence that is at least 80% homologous to SEQ ID NO. 17 and is encoded by a DNA sequence which comprises one or more codon substitutions, relative to a wildtype sequence, at a codon position which corresponds to an amino acid position in SEQ ID NO. 17 selected from the group consisting of position 75, 160, 191, 256, 359, 366, and 500.

43. The engineered host cell of clause 40, wherein said reductase component comprises a sequence that is at least 80% homologous to SEQ ID NO. 18.

44. An engineered split epimerase that comprises one or more mutations selected from the group consisting of a localization mutation, a cytochrome P450 reductase interaction mutation, and an accessibility mutation.

45. The engineered split epimerase of clause 44, wherein said engineered split epimerase comprises an oxidase component and a reductase component.

46. The engineered split epimerase of clause 44, wherein said engineered split epimerase has increased activity compared to a wildtype fused epimerase.

47. The engineered split epimerase of clause 44, wherein said engineered split epimerase comprises one or more mutations that increase activity of said engineered split epimerase.

48. The engineered split epimerase of clause 45, wherein said oxidase component comprises a sequence that is encoded by a DNA sequence which comprises one or more mutations, relative to a wildtype sequence, each mutation at a codon position which corresponds to a position selected from the group consisting of positions 16, 17, 37, 50, 64, 69, 70, 110, 128, 155, 232, 234, 244, 293, 303, 328, 354, 387, 393, 427, and 477 within SEQ ID NO. 17.

49. The engineered split epimerase of clause 45, wherein said oxidase component comprises a sequence that is at least 80% homologous to SEQ ID NO. 17 and is encoded by a DNA sequence which comprises one or more codon substitutions, relative to a wildtype sequence, at a codon position which corresponds to an amino acid position in SEQ ID NO. 17 selected from the group consisting of position 75, 160, 191, 256, 359, 366, and 500.

50. The engineered split epimerase of clause 45, wherein said reductase component comprises a sequence that is at least 80% homologous to SEQ ID NO. 18.

51. An engineered host cell which comprises an engineered split epimerase, wherein said engineered split epimerase increases conversion of a (S)-1-benzylisoquinoline alkaloid to a (R)-1-benzylisoquinoline alkaloid relative to conversion of a (S)-1-benzylisoquinoline alkaloid to a (R)-1-benzylisoquinoline alkaloid via a fused epimerase under similar conditions.

52. The engineered host cell of clause 51, wherein said engineered split epimerase comprises one or more mutations that increase activity of said engineered split epimerase.

53. The engineered host cell of clause 51, wherein said engineered split epimerase comprises one or more mutations selected from the group consisting of a localization mutation, a cytochrome P450 reductase interaction mutation, and an accessibility mutation.

54. The engineered host cell of clause 51, wherein said engineered split epimerase comprises an oxidase component and a reductase component.

55. The engineered host cell of clause 54, wherein said oxidase component comprises a sequence that is encoded by a DNA sequence which comprises one or more mutations, relative to a wildtype sequence, each mutation at a codon position which corresponds to a position selected from the group consisting of positions 16, 17, 37, 50, 64, 69, 70, 110, 128, 155, 232, 234, 244, 293, 303, 328, 354, 387, 393, 427, and 477 within SEQ ID NO. 17.

56. The engineered host cell of clause 54, wherein said oxidase component comprises a sequence that is at least 80% homologous to SEQ ID NO. 17 and is encoded by a DNA sequence which comprises one or more codon substitutions, relative to a wildtype sequence, at a codon position which is equivalent to an amino acid position in SEQ ID NO. 17 selected from the group consisting of position 75, 160, 191, 256, 359, 366, and 500.

57. An engineered split epimerase that comprises one or more mutations selected from the group consisting of a localization mutation, a cytochrome P450 reductase interaction mutation, and an accessibility mutation.

58. The engineered split epimerase of clause 57, wherein said engineered split epimerase has increased activity compared to a wildtype fused epimerase.

59. The engineered split epimerase of clause 57, wherein said engineered split epimerase comprises one or more mutations that increase activity of said engineered split epimerase.

60. The engineered split epimerase of clause 57, wherein said engineered split epimerase comprises an oxidase component and a reductase component.

61. The engineered split epimerase of clause 60, wherein said oxidase component comprises a sequence that is at least 80% homologous to SEQ ID NO. 17.

62. The engineered split epimerase of clause 60, wherein said oxidase component comprises a sequence that is at least 85% homologous to SEQ ID NO. 17.

63. The engineered split epimerase of clause 60, wherein said oxidase component comprises a sequence that is at least 90% homologous to SEQ ID NO. 17.

64. The engineered split epimerase of clause 60, wherein said oxidase component comprises a sequence that is at least 95% homologous to SEQ ID NO. 17.

65. The engineered split epimerase of clause 60, wherein said reductase component comprises a sequence that is at least 80% homologous to SEQ ID NO. 18.

66. The engineered split epimerase of clause 60, wherein said reductase component comprises a sequence that is at least 85% homologous to SEQ ID NO. 18.

67. The engineered split epimerase of clause 60, wherein said reductase component comprises a sequence that is at least 90% homologous to SEQ ID NO. 18.

68. The engineered split epimerase of clause 60, wherein said reductase component comprises a sequence that is at least 95% homologous to SEQ ID NO. 18.

69. The engineered split epimerase of clause 60, wherein said oxidase component comprises one or more mutations, each mutation at a codon position which corresponds to a position selected from the group consisting of positions 16, 17, 37, 50, 64, 69, 70, 110, 128, 155, 232, 234, 244, 293, 303, 328, 354, 387, 393, 427, and 477 within SEQ ID NO. 17.

70. The engineered split epimerase of clause 60, wherein said oxidase component comprises a sequence that is encoded by a DNA sequence which comprises one or more codon substitutions, relative to a wildtype sequence, at a codon position which corresponds to an amino acid position in SEQ ID NO. 17 selected from the group consisting of position 75, 160, 191, 256, 359, 366 and 500.

71. A method of producing an alkaloid product through the epimerization of a (S)-1-benzylisoquinoline alkaloid to a (R)-1-benyzlisoquinoline alkaloid via an engineered split epimerase in an engineered host cell said method comprising:

contacting said (S)-1-benzylisoquinoline alkaloid with said engineered split epimerase in said engineered host cell, thereby increasing production of an alkaloid product, wherein contacting said (S)-1-benzylisoquinoline alkaloid with said engineered split epimerase converts said (S)-1-benzylisoquinoline alkaloid to said (R)-1-benzylisoquinoline alkaloid within said engineered host cell, wherein said engineered split epimerase comprises an oxidase component and a reductase component, wherein said oxidase component comprises a sequence that is at least 80% homologous to SEQ ID NO. 17, and wherein said reductase component comprises a sequence that is at least 80% homologous to SEQ ID NO. 18.

72. The method of clause 71, wherein said engineered split epimerase comprises one or more mutations that increase activity of said engineered split epimerase.

73. The method of clause 71, wherein said engineered split epimerase comprises one or more mutations selected from the group consisting of a localization mutation, a cytochrome P450 reductase interaction mutation, and an accessibility mutation.

74. The method of clause 71, wherein said oxidase component comprises a sequence that is encoded by a DNA sequence which comprises one or more mutations, each mutation at a codon position which corresponds to a position selected from the group consisting of positions 16, 17, 37, 50, 64, 69, 70, 110, 128, 155, 232, 234, 244, 293, 303, 328, 354, 387, 393, 427, and 477 within SEQ ID NO. 17.

75. The method of clause 71, wherein said oxidase component comprises a sequence that is at least 85% homologous to SEQ ID NO. 17.

76. The method of clause 71, wherein said oxidase component comprises a sequence that is at least 90% homologous to SEQ ID NO. 17.

77. The method of clause 71, wherein said oxidase component comprises a sequence that is at least 95% homologous to SEQ ID NO. 17.

78. The method of clause 71, wherein said oxidase component comprises a sequence that is encoded by a DNA sequence which comprises one or more codon substitutions, relative to a wildtype sequence, at a codon position which corresponds to an amino acid position in SEQ ID NO. 17 selected from the group consisting of position 75, 160, 191, 256, 359, 366, and 500.

79. The method of clause 71, wherein said reductase component comprises a sequence that is at least 85% homologous to SEQ ID NO. 18.

80. The method of clause 71, wherein said reductase component comprises a sequence that is at least 90% homologous to SEQ ID NO. 18.

81. The method of clause 71, wherein said reductase component comprises a sequence that is at least 95% homologous to SEQ ID NO. 18.

82. The method of any of the previous clauses, wherein said fused epimerase is a wildtype epimerase.

83. The method of any of the previous clauses, wherein said fused epimerase is a parent epimerase of said engineered split epimerase.

84. The method of any of the previous clauses, wherein said fused epimerase is an engineered fused epimerase comprising an oxidase domain with a same sequence as said oxidase component of said engineered split epimerase.

85. The method of any of the previous clauses, wherein said fused epimerase is an engineered fused epimerase comprising a reductase domain with a same sequence as said reductase component of said engineered split epimerase.

86. The engineered host cell of any of the previous clauses, wherein said fused epimerase is a wildtype epimerase.

87. The engineered host cell of any of the previous clauses, wherein said fused epimerase is a parent epimerase of said engineered split epimerase.

88. The engineered host cell of any of the previous clauses, wherein said fused epimerase is an engineered fused epimerase comprising an oxidase domain with a same sequence as said oxidase component of said engineered split epimerase.

89. The engineered host cell of any of the previous clauses, wherein said fused epimerase is an engineered fused epimerase comprising a reductase domain with a same sequence as said reductase component of said engineered split epimerase.

90. The method of any of the previous clauses, wherein the oxidase component has a cytochrome P450 oxidase-like domain.

91. The method of any of the previous clauses, wherein the reductase component has a codeinone reductase-like domain.

92. A method of producing an alkaloid product through the epimerization of a (S)-1-benzylisoquinoline alkaloid to a (R)-1-benyzlisoquinoline alkaloid via an engineered fused epimerase in an engineered host cell, said method comprising:

contacting said (S)-1-benzylisoquinoline alkaloid with said engineered fused epimerase in said engineered host cell, wherein said engineered fused epimerase comprises one or more mutations that increase activity of said engineered fused epimerase, wherein contacting said (S)-1-benzylisoquinoline alkaloid with said engineered fused epimerase converts said (S)-1-benzylisoquinoline alkaloid to said (R)-1-benzylisoquinoline alkaloid within said engineered host cell.

93. The method of clause 92, wherein said engineered fused epimerase comprises one or more mutations selected from the group consisting of a localization mutation, a cytochrome P450 reductase interaction mutation, and an accessibility mutation.

94. The method of clause 92, wherein said engineered fused epimerase comprises a sequence that is encoded by a DNA sequence which comprises one or more mutations, relative to a wildtype sequence, each mutation at a codon position which corresponds to a position that is selected from the group consisting of positions 16, 17, 37, 50, 64, 69, 70, 110, 128, 155, 232, 234, 244, 293, 303, 328, 354, 387, 393, 427, and 477 within SEQ ID NO. 16.

95. The method of clause 92, wherein said engineered fused epimerase comprises a sequence that is encoded by a DNA sequence which comprises one or more codon substitutions, relative to a wildtype sequence, at a codon position which corresponds to an amino acid position in SEQ ID NO. 16 selected from the group consisting of position 75, 160, 191, 256, 359, 366, and 500.

96. The method of clause 92, wherein said engineered fused epimerase comprises a sequence that is at least 80% homologous to SEQ ID NO. 16.

97. The method of clause 92, wherein said engineered fused epimerase comprises a sequence that is at least 85% homologous to SEQ ID NO. 16.

98. The method of clause 92, wherein said engineered fused epimerase comprises a sequence that is at least 90% homologous to SEQ ID NO. 16.

99. The method of clause 92, wherein said engineered fused epimerase comprises a sequence that is at least 95% homologous to SEQ ID NO. 16.

100. A method of increasing production of an alkaloid product through the epimerization of a (S)-1-benzylisoquinoline alkaloid to a (R)-1-benyzlisoquinoline alkaloid via an engineered fused epimerase in an engineered host cell in comparison to the epimerization of a (S)-1-benzylisoquinoline alkaloid to a (R)-1-benyzlisoquinoline alkaloid via a wildtype fused epimerase in similar conditions, said method comprising:
 contacting said (S)-1-benzylisoquinoline alkaloid with said engineered fused epimerase in said engineered host cell, thereby increasing production of an alkaloid product,
 wherein contacting said (S)-1-benzylisoquinoline alkaloid with said engineered fused epimerase converts said (S)-1-benzylisoquinoline alkaloid to said (R)-1-benzylisoquinoline alkaloid within said engineered host cell, and wherein said engineered fused epimerase produces at least 1% more of said (R)-1-benzylisoquinoline alkaloid than a wildtype fused epimerase under similar conditions.

101. The method of clause 100, wherein said engineered fused epimerase produces at least 3% more of said (R)-1-benzylisoquinoline alkaloid than a wildtype fused epimerase under similar conditions.

102. The method of clause 100, wherein said engineered fused epimerase produces at least 5% more of said (R)-1-benzylisoquinoline alkaloid than a wildtype fused epimerase under similar conditions.

103. The method of clause 100, wherein said engineered fused epimerase produces at least 10% more of said (R)-1-benzylisoquinoline alkaloid than a wildtype fused epimerase under similar conditions.

104. The method of clause 100, wherein said engineered fused epimerase produces at least 15% more of said (R)-1-benzylisoquinoline alkaloid than a wildtype fused epimerase under similar conditions.

105. The method of clause 100, wherein said engineered fused epimerase produces at least 20% more of said (R)-1-benzylisoquinoline alkaloid than a wildtype fused epimerase under similar conditions.

106. The method of clause 100, wherein said engineered fused epimerase produces at least 25% more of said (R)-1-benzylisoquinoline alkaloid than a wildtype fused epimerase under similar conditions.

107. The method of clause 100, wherein said engineered fused epimerase produces at least 30% more of said (R)-1-benzylisoquinoline alkaloid than a wildtype fused epimerase under similar conditions.

108. The method of clause 100, wherein said engineered fused epimerase comprises one or more mutations that increase activity of said engineered fused epimerase.

109. The method of clause 100, wherein said engineered fused epimerase comprises one or more mutations selected from the group consisting of a localization mutation, a cytochrome P450 reductase interaction mutation, and an accessibility mutation.

110. The method of clause 100, wherein said engineered fused epimerase comprises a sequence that is encoded by a DNA sequence which comprises one or more mutations, relative to a wildtype sequence, each mutation at a codon position which corresponds to a position that is selected from the group consisting of positions 16, 17, 37, 50, 64, 69, 70, 110, 128, 155, 232, 234, 244, 293, 303, 328, 354, 387, 393, 427, and 477 within SEQ ID NO. 16.

111. The method of clause 100, wherein said engineered fused epimerase comprises a sequence that is encoded by a DNA sequence which comprises one or more codon substitutions, relative to a wildtype sequence, at a codon position which corresponds to an amino acid position in SEQ ID NO. 16 selected from the group consisting of position 75, 160, 191, 256, 359, 366, and 500.

112. The method of clause 100, wherein said engineered fused epimerase comprises a sequence that is at least 80% homologous to SEQ ID NO. 16.

113. The method of clause 100, wherein said engineered fused epimerase comprises a sequence that is at least 85% homologous to SEQ ID NO. 16.

114. The method of clause 100, wherein said engineered fused epimerase comprises a sequence that is at least 90% homologous to SEQ ID NO. 16.

115. The method of clause 100, wherein said engineered fused epimerase comprises a sequence that is at least 95% homologous to SEQ ID NO. 16.

116. An engineered host cell which comprises an engineered fused epimerase, wherein said epimerase increases conversion of a (S)-1-benzylisoquinoline alkaloid to a (R)-1-benzylisoquinoline alkaloid, and wherein said engineered fused epimerase produces more of said (R)-1-benzylisoquinoline alkaloid than a wildtype fused epimerase under similar conditions.

117. The engineered host cell of clause 116, wherein said engineered fused epimerase comprises one or more mutations that increase activity of said engineered fused epimerase.

118. The engineered host cell of clause 116, wherein said engineered fused epimerase comprises one or more mutations selected from the group consisting of a localization mutation, a cytochrome P450 reductase interaction mutation, and an accessibility mutation.

119. The engineered host cell of clause 116, wherein said engineered fused epimerase comprises a sequence that is encoded by a DNA sequence which comprises one or more mutations, relative to a wildtype sequence, each mutation at a codon position which corresponds to a position that is selected from the group consisting of positions 16, 17, 37, 50, 64, 69, 70, 110, 128, 155, 232, 234, 244, 293, 303, 328, 354, 387, 393, 427, and 477 within SEQ ID NO. 16.

120. The engineered host cell of clause 116, wherein said engineered fused epimerase comprises a sequence that is at least 80% homologous to SEQ ID NO. 16 and is encoded by a DNA sequence which comprises one or more codon substitutions, relative to a wildtype sequence, at a codon position which corresponds to an amino acid position in SEQ ID NO. 16 selected from the group consisting of position 75, 160, 191, 256, 359, 366, and 500.

121. An engineered fused epimerase that comprises one or more mutations selected from the group consisting of a localization mutation, a cytochrome P450 reductase interaction mutation, and an accessibility mutation.

122. The engineered epimerase of clause 121, wherein said engineered fused epimerase has increased activity compared to a wildtype fused epimerase.

123. The engineered fused epimerase of clause 121, wherein said engineered fused epimerase comprises one or more mutations that increase activity of said engineered fused epimerase.

124. The engineered fused epimerase of clause 121, wherein said engineered fused epimerase comprises a sequence that is encoded by a DNA sequence which comprises one or more mutations, relative to a wildtype sequence, each mutation at a codon position which corresponds to a position that is selected from the group consisting of positions 16, 17, 37, 50, 64, 69, 70, 110, 128, 155, 232, 234, 244, 293, 303, 328, 354, 387, 393, 427, and 477 within SEQ ID NO. 16.

125. The engineered fused epimerase of clause 121, wherein said engineered fused epimerase comprises a sequence that is at least 80% homologous to SEQ ID NO. 16 and is encoded by a DNA sequence which comprises one or more codon substitutions, relative to a wildtype sequence, at a codon position which is equivalent to an amino acid position in SEQ ID NO. 16 selected from the group consisting of position 75, 160, 191, 256, 359, 366, and 500.

126. A method for forming a product stream having a benzylisoquinoline alkaloid product, comprising:
(a) providing engineered host cells and a feedstock including nutrients and water to a batch reactor, which engineered host cells comprise at least one heterologous coding sequence encoding at least one engineered epimerase, wherein the engineered epimerase is an engineered split epimerase or engineered fused epimerase from any of the previous clauses;
(b) in said batch reactor, subjecting said engineered host cells to fermentation by incubating said engineered host cells for a time period of at least about 5 minutes to produce a solution comprising said benzylisoquinoline alkaloid product and cellular material; and
(c) using at least one separation unit to separate said benzylisoquinoline alkaloid product from said cellular material to provide said product stream comprising said benzylisoquinoline alkaloid product.

127. The method of clause 126, wherein at least one process parameter of the batch reactor is modifiable to alter a resultant benzylisoquinoline alkaloid product composition.

128. The method of clause 126, wherein the at least one process parameter that is modifiable comprises at least one of dissolved oxygen, pH, stirring speed, aeration rate, and cell density.

129. A medicinal product that comprises the benzylisoquinoline alkaloid product produced from any of the previous clauses.

130. The medicinal product of clause 129, wherein the medicinal product has cancer therapeutic properties.

131. The medicinal product of clause 129, wherein the medicinal product has analgesic properties.

132. The medicinal product of clause 129, wherein the medicinal product has antimalarial properties.

133. The medicinal product of clause 129, wherein the medicinal product has antitussive properties.

134. The medicinal product of clause 129, wherein the medicinal product has opioid overdose treatment properties.

135. The medicinal product of clause 129, wherein the medicinal product has anti-addiction properties.

136. The method of any of the previous clauses, wherein said product is further processed within said engineered host cell to produce a nal-opioid product.

137. The method of any of the previous clauses, wherein said product is further processed within said engineered host cell to produce a nor-opioid product.

138. The method of any of the previous clauses, wherein said product is further processed within said engineered host cell to produce a bisbenzylisoquinoline alkaloid product.

139. The engineered host cell of any of the previous clauses, wherein said engineered host cell is engineered to convert said product to a nal-opioid product.

140. The engineered host cell of any of the previous clauses, wherein said engineered host cell is engineered to convert said product to a nor-opioid product.

141. The engineered host cell of any of the previous clauses, wherein said engineered host cell is engineered to convert said product to a bisbenzylisoquinoline alkaloid product.

142. The engineered host cell of any of the previous clauses, wherein said engineered host cell is engineered to convert said product to a promorphinan alkaloid product.

143. The engineered host cell of any of the previous clauses, wherein said engineered host cell is engineered to convert said product to a morphinan alkaloid product.

144. The method of any of the previous clauses, wherein the engineered fused epimerase comprises an oxidase domain and a reductase domain.

145. The method of clause 144, wherein the oxidase domain is a cytochrome P450 oxidase-like domain.

146. The method of clause 144, wherein the reductase domain is a codeinone reductase-like domain.

147. The method of any of the previous clauses, wherein the (S)-1-benzylisoquinoline alkaloid is (S)-reticuline.

148. The method of any of the previous clauses, wherein the (R)-1-benzylisoquinoline alkaloid is (R)-reticuline.

149. The method of any of the previous clauses, further comprising: converting the (R)-1-benzylisoquinoline alkaloid to a 4-ring promorphinan alkaloid.

150. The method of clause 75, wherein the 4-ring promorphinan alkaloid is salutaridine.

151. The method of any of the previous clauses, further comprising: converting the (R)-1-benzylisoquinoline alkaloid to a 5-ring morphinan alkaloid.

152. The method of any of the previous clauses, further comprising: converting the (R)-1-benzylisoquinoline alkaloid to a bisbenzylisoquinoline alkaloid.

153. The method of any of the previous clauses, further comprising: converting the (R)-1-benzylisoquinoline alkaloid to a nal-opioid.

154. The method of any of the previous clauses, further comprising: converting the (R)-1-benzylisoquinoline alkaloid to a nor-opioid.

155. The method of any of the previous clauses, further comprising: converting the (R)-1-benzylisoquinoline alkaloid to a promorphinan.

156. The method of any of the previous clauses, further comprising: converting the (R)-1-benzylisoquinoline alkaloid to a morphinan.

157. The method of any of the previous clauses, wherein the (S)-1-benzylisoquinoline alkaloid present within the engineered host cell is produced within an engineered microbial cell.

158. The method of any of the previous clauses, wherein the (S)-1-benzylisoquinoline alkaloid is produced within the engineered host cell by a metabolic pathway starting with L-tyrosine.

159. The method of any of the previous clauses, wherein the (S)-1-benzylisoquinoline alkaloid is produced within the engineered host cell by a metabolic pathway starting with a carbohydrate and nitrogen source.

160. The method of any of the previous clauses, wherein the (S)-1-benzylisoquinoline alkaloid is selected from the group consisting of: (S)-norreticuline; (S)-reticuline; (S)-tetrahydropapaverine; (S)-norcoclaurine; (S)-coclaurine; (S)—N-methylcoclaurine; (S)-3'-hydroxy-N-methylcoclaurine; (S)-norisoorientaline; (S)-orientaline; (S)-isoorientaline; (S)-norprotosinomenine; (S)-protosinomenine; (S)-norlaudanosoline; (S)-laudanosoline; (S)-4'-O-methyllaudanosoline; (S)-6-O-methylnorlaudanosoline; and (S)-4'-O-methylnorlaudanosoline.

161. The method of any one of the previous clauses wherein the (S)-1-benzylisoquinoline alkaloid is a compound of Formula I:

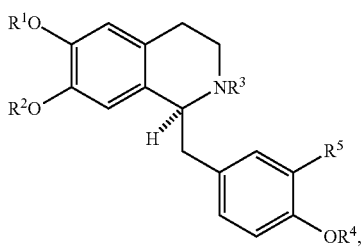

Formula I wherein:
$R^1$, $R^2$, $R^3$, and $R^4$ are independently hydrogen or methyl; and
$R^5$ is hydrogen, hydroxy, or methoxy.

162. The method of any one of the above clauses, wherein said engineered host cell is an engineered non-plant cell.

163. The method of any one of the above clauses, wherein said engineered host cell is an engineered yeast cell.

164. The method of any one of the above clauses, wherein said engineered host cell is an engineered bacteria cell.

165. The engineered host cell of any of the previous clauses, wherein the engineered fused epimerase comprises an oxidase domain and a reductase domain.

166. The engineered host cell of clause 165, wherein the oxidase component has a cytochrome P450 oxidase-like domain.

167. The engineered host cell of clause 165, wherein the reductase component has a codeinone reductase-like domain.

168. The engineered host cell of any one of the above clauses, wherein said engineered host cell is an engineered non-plant cell.

169. The engineered host cell of any one of the above clauses, wherein said engineered host cell is an engineered yeast cell.

170. The engineered host cell of any one of the above clauses, wherein said engineered host cell is an engineered bacteria cell.

171. A method of increasing production of an alkaloid product through the epimerization of an (S)-1-benzylisoquinoline alkaloid to a (R)-1-benyzlisoquinoline alkaloid via an engineered epimerase in an engineered host cell, said method comprising:
contacting said (S)-1-benzylisoquinoline alkaloid with said engineered epimerase,
wherein contacting said (S)-1-benzylisoquinoline alkaloid with said engineered epimerase converts said (S)-1-benzylisoquinoline alkaloid to said (R)-1-benzylisoquinoline alkaloid.

172. The method of clause 171, wherein said engineered epimerase is an engineered split epimerase.

173. The method of clause 172, wherein said engineered split epimerase increases said production of said alkaloid product in comparison to an epimerization via a wild-type fused epimerase.

174. The method of clause 172, wherein said engineered split epimerase comprises one or more mutations that increase activity of said engineered split epimerase.

175. The method of clause 172, wherein said engineered split epimerase comprises one or more mutations selected from the group consisting of a localization mutation, a cytochrome P450 reductase interaction mutation, and an accessibility mutation.

176. The method of clause 172, wherein said engineered split epimerase comprises one or more mutations, each mutation at a position which is equivalent to a position within SEQ ID NO. 16 selected from the group consisting of positions 16, 17, 37, 50, 64, 69, 70, 110, 128, 155, 232, 234, 244, 293, 303, 328, 354, 387, 393, 427, and 477 within SEQ ID NO. 16.

177. The method of clause 172, wherein said engineered split epimerase comprises a sequence that is at least 80% homologous to SEQ ID NO. 16 and is encoded by a DNA sequence which comprises one or more codon substitutions, relative to a wildtype sequence, at a codon position which is equivalent to an amino acid position in SEQ ID NO. 16 selected from the group consisting of position 75, 160, 191, 256, 359, 366 and 500.

178. The method of clause 171, wherein said engineered epimerase is an engineered fused epimerase.

179. The method of clause 178, wherein said engineered fused epimerase comprises one or more mutations that increase activity of said engineered fused epimerase.

180. The method of clause 178, wherein said engineered fused epimerase comprises one or more mutations selected from the group consisting of a localization mutation, a cytochrome P450 reductase interaction mutation, and an accessibility mutation.

181. The method of clause 178, wherein said engineered fused epimerase comprises one or more mutations, each mutation at a position which is equivalent to a position within SEQ ID NO. 16 selected from the group consisting of positions 16, 17, 37, 50, 64, 69, 70, 110, 128, 155, 232, 234, 244, 293, 303, 328, 354, 387, 393, 427, and 477 within SEQ ID NO. 16.

182. The method of clause 178, wherein said engineered fused epimerase comprises a sequence that is at least 80% homologous to SEQ ID NO. 16 and is encoded by a DNA sequence which comprises one or more codon substitutions, relative to a wildtype sequence, at a codon position which is equivalent to an amino acid position in SEQ ID NO. 16 selected from the group consisting of position 75, 160, 191, 256, 359, 366 and 500.

183. The method of any one of the above clauses 171-182, wherein said engineered host cell is an engineered non-plant cell.

184. An engineered host cell which comprises an engineered epimerase, wherein said epimerase increases conversion of a (S)-1-benzylisoquinoline alkaloid to a (R)-1-benzylisoquinoline alkaloid.

185. The engineered host cell of clause 184, wherein said engineered epimerase is an engineered split epimerase.

186. The engineered host cell of clause 185, wherein said engineered split epimerase increases production of said alkaloid product in comparison to an epimerization via a wild-type fused epimerase.

187. The engineered host cell of clause 185, wherein said engineered split epimerase comprises one or more mutations that increase activity of said engineered split epimerase.

188. The engineered host cell of clause 185, wherein said engineered split epimerase comprises one or more mutations selected from the group consisting of a localization mutation, a cytochrome P450 reductase interaction mutation, and an accessibility mutation.

189. The engineered host cell of clause 185, wherein said engineered split epimerase comprises one or more mutations, each mutation at a position which is equivalent to a position within SEQ ID NO. 16 selected from the group consisting of positions 16, 17, 37, 50, 64, 69, 70, 110, 128, 155, 232, 234, 244, 293, 303, 328, 354, 387, 393, 427, and 477 within SEQ ID NO. 16.

190. The engineered host cell of clause 185, wherein said engineered split epimerase comprises a sequence that is at least 80% homologous to SEQ ID NO. 16 and is encoded by a DNA sequence which comprises one or more codon substitutions, relative to a wildtype sequence, at a codon position which is equivalent to an amino acid position in SEQ ID NO. 16 selected from the group consisting of position 75, 160, 191, 256, 359, 366 and 500.

191. The engineered host cell of clause 184, wherein said engineered epimerase is an engineered fused epimerase.

192. The engineered host cell of clause 191, wherein said engineered fused epimerase comprises one or more mutations that increase activity of said engineered fused epimerase.

193. The engineered host cell of clause 191, wherein said engineered split epimerase comprises one or more mutations selected from the group consisting of a localization mutation, a cytochrome P450 reductase interaction mutation, and an accessibility mutation.

194. The engineered host cell of clause 191, wherein said engineered fused epimerase comprises one or more mutations, each mutation at a position which is equivalent to a position within SEQ ID NO. 16 selected from the group consisting of positions 16, 17, 37, 50, 64, 69, 70, 110, 128, 155, 232, 234, 244, 293, 303, 328, 354, 387, 393, 427, and 477 within SEQ ID NO. 16.

195. The engineered host cell of clause 191, wherein said engineered fused epimerase comprises a sequence that is at least 80% homologous to SEQ ID NO. 16 and is encoded by a DNA sequence which comprises one or more codon substitutions, relative to a wildtype sequence, at a codon position which is equivalent to an amino acid position in SEQ ID NO. 16 selected from the group consisting of position 75, 160, 191, 256, 359, 366 and 500.

196. The engineered host cell of any one of clauses 184-195, wherein said engineered host cell is an engineered non-plant cell.

197. An engineered epimerase that comprises one or more mutations selected from the group consisting of a localization mutation, a cytochrome P450 reductase interaction mutation, and an accessibility mutation.

198. The engineered epimerase of clause 197, wherein said engineered epimerase is an engineered split epimerase.

199. The engineered epimerase of clause 197, wherein said engineered split epimerase has increased activity compared to a wildtype fused epimerase.

200. The engineered epimerase of clause 197, wherein said engineered split epimerase comprises one or more mutations that increase activity of said engineered split epimerase.

201. The engineered epimerase of clause 197, wherein said engineered split epimerase comprises one or more mutations, each mutation at a position which is equivalent to a position within SEQ ID NO. 16 selected from the group consisting of positions 16, 17, 37, 50, 64, 69, 70, 110, 128, 155, 232, 234, 244, 293, 303, 328, 354, 387, 393, 427, and 477 within SEQ ID NO. 16.

202. The engineered epimerase of clause 197, wherein said engineered split epimerase comprises a sequence that is at least 80% homologous to SEQ ID NO. 16 and is encoded by a DNA sequence which comprises one or more codon substitutions, relative to a wildtype sequence, at a codon position which is equivalent to an amino acid position in SEQ ID NO. 16 selected from the group consisting of position 75, 160, 191, 256, 359, 366 and 500.

203. An engineered epimerase, wherein said engineered epimerase is an engineered fused epimerase that comprises one or more mutations selected from the group consisting of a localization mutation, a cytochrome P450 reductase interaction mutation, and an accessibility mutation.

204. The engineered epimerase of clause 203, wherein said engineered fused epimerase comprises one or more mutations at a position corresponding to SEQ ID NO. 16, said one or more mutations corresponding to a position selected from the group consisting of position 16, 17, 37, 50, 64, 69, 70, 110, 128, 155, 232, 234, 244, 293, 303, 328, 354, 387, 393, 427, and 477.

205. The engineered epimerase of clause 203, wherein said engineered fused epimerase comprises a sequence that is at least 80% homologous to SEQ ID NO. 16 and is encoded by a DNA sequence which comprises one or more codon substitutions, relative to a wildtype sequence, at a codon position which is equivalent to an amino acid position in SEQ ID NO. 16 selected from the group consisting of position 75, 160, 191, 256, 359, 366 and 500.

While preferred embodiments of the invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (153 sequences)

SEQ ID NO: 1 - protein, 901 aa, Papaver somniferum
MELQYISYFQPTSSVVALLLALVSILSSVVVLRKTFLNNYSSSPASSTKTAVLSHQRQQSCALPISGLLHIFMNKNGLIHVTLGNMADKYGPIFSFPTGSHRTLVVSSWEMVKECFTGNNDTAFSNRPIPLAFKTIFYACGGIDSYGLSSVPYGKYWRELRKVCVHNLLSNQQLLKFRHLIISQVDTSFNKLYELCKNSEDNHGNYTTTTTTAAGMVRIDDWLAELSFNVIGRIVCGFQSGPKTGAPSRVEQFKEAINEASYFMSTSPVSDNVPMLGWIDQLTGLTRNMKHCGKKLDLVVESIINDHRQKRRFSRTKGGDEKDDEQDDFIDICLSIMEQPQLPGNNNPSQIPIKSIVLDMIGGGTDTTKLTTIWTLSLLLNNPHVLDKAKQEVDAHFRTKRRSTNDAAAAVVDFDDIRNLVYIQAIIKESMRLYPASPVVERLSGEDCVVGGFHVPAGTRLWANVWKMQRDPKVWDDPLVFRPDRFLSDEQKMVDVRGQNYELLPFGAGRRVCPGVSFSLDLMQLVLTRLILEFEMKSPSGKVDMTATPGLMSYKVIPLDILLTHRRIKPCVQSAASERDMESSGVPVITLGSGKVMPVLGMGTFEKVGKGSERERLAILKAIEVGYRYFDTAAAYETEEVLGEAIAEALQLGLVKSRDELFISSMLWCTDAHADRVLLALQNSLRNLKLEYVDLYMLPFPASLKPGKITMDIPEEDICRMDYRSVWAAMEECQNLGFTKSIGVSNFSCKKLQELMATANIPPAVNQVEMSPAFQQKKLREYCNANNILVSAISVLGSNGTPWGSNAVLGSEVLKKIAMAKGKSVAQVSMRWVYEQGASLVVKSFSEERLRENLNIFDWELTKEDHEKIGEIPQCRILSAYFLVSPNGPFKSQEELWDDEA

SEQ ID NO: 2 - protein, 919 aa, Papaver somniferum
  MOD_RES (209)..(209): Any amino acid
  MOD_RES (226)..(226): Any amino acid
MELQYISYFQPTSSVVALLLALVSILSSVVVLRKTFLNNYSSSPASSTKTAVLSHQRQQSCALPISGLLHIFMNKNGLIHVTLGNMADKYGPIFSFPTGSHRTLVVSSWEMVKECFTGNNDTAFSNRPIPLAFKTIFYACGGIDSYGLSSVPYGKYWRELRKVCVHNLLSNQQLLKFRHLIISQVDTSFNKLYELCKNSEDNHGNYTTXLLLPQLAWRQPWKLYYXTTTTAAGMVRIDDWLAELSFNVIGRIVCGFQSGPKTGAPSRVEQFKEAINEASYFMSTSPVSDNVPMLGWIDQLTGLTRNMKHCGKKLDLVVESIINDHRQKRRFSRTKGGDEKDDEQDDFIDICLSIMEQPQLPGNNNPSQIPIKSIVLDMIGGGTDTTKLTTIWTLSLLLNNPHVLDKAKQEVDAHFRTKRRSTNDAAAAVVDFDDIRNLVYIQAIIKESMRLYPASPVVERLSGEDCVVGGFHVPAGTRLWANVWKMQRDPKVWDDPLVFRPDRFLSDEQKMVDVRGQNYELLPFGAGRRVCPGVSFSLDLMQLVLTRLILEFEMKSPSGKVDMTATPGLMSYKVIPLDILLTHRRIKPCVQSAASERDMESSGVPVITLGSGKVMPVLGMGTFEKVGKGSERERLAILKAIEVGYRYFDTAAAYETEEVLGEAIAEALQLGLVKSRDELFISSMLWCTDAHADRVLLALQNSLRNLKLEYVDLYMLPFPASLKPGKITMDIPEEDICRMDYRSVWAAMEECQNLGFTKSIGVSNFSCKKLQELMATANIPPAVNQVEMSPAFQQKKLREYCNANNILVSAISVLGSNGTPWGSNAVLGSEVLKKIAMAKGKSVAQVSMRWVYEQGASLVVKSFSEERLRENLNIFDWELTKEDHEKIGEIPQCRILSAYFLVSPNGPFKSQEELWDDEA

SEQ ID NO: 3 - protein, 732 aa, Papaver somniferum
  MOD_RES (725)..(725): Any amino acid
MELQYISYFQPTSSVVALLLALVSILSSVVVLRKTFLNNYSSSPASSTKTAVLSHQRQQSCALPISGLLHIFMNKNGLIHVTLGNMADKYGPIFSFPTGSHRTLVVSSWEMVKECFTGNNDTAFSNRPIPLAFKTIFYACGGIDSYGLSSVPYGKYWRELRKVCVHNLLSNQQLLKFRHLIISQVDTSFNKLYELCKNSEDNHGNYTTTTTTAAGMVRIDDWLAELSFNVIGRIVCGFQSGPKTGAPSRVEQFKEAINEASYFMSTSPVSDNVPMLGWIDQLTGLTRNMKHCGKKLDLVVESIINDHRQKRRFSRTKGGDEKDDEQDDFIDICLSIMEQPQLPGNNNPSQIPIKSIVLDMIGGGTDTTKLTTIWTLSLLLNNPHVLDKAKQEVDAHFRTKRRSTNDAAAAVVDFDDIRNLVYIQAIIKESMRLYPASPVVERLSGEDCVVGGFHVPAGTRLWANVWKMQRDPKVWDDPLVFRPDRFLSDEQKMVDVRGQNYELLPFGAGRRVCPGVSFSLDLMQLVLTRLILEFEMKSPSGKVDMTATPGLMSYKVIPLDILLTHRRIKPCVQSAASERDMESSGVPVITLGSGKVMPVLGMGTFEKVGKGSERERLAILKAIEVGYRYFDTAAAYETEEVLGEAIAEALQLGLVKSRDELFISSMLWCTDAHADRVLLALQNSLRNLKLEYVDLYMLPFPASLKPGKITMDIPEEDICRMDYRXVSKPWLH

SEQ ID NO: 4 - protein, 764 aa, Papaver somniferum
  MOD_RES (6)..(6): Any amino acid
MRWHRXIDSYGLSSVPYGKYWRELRKVCVHNLLSNQQLLKFRHLIISQVDTSFNKLYELCKNSEDNQGNYPTTTTAAGMVRIDDWLAELSFNVIGRIVCGFQSGPKTGAPSRVEQFKEAINEASYFMSTSPVSDNVPMLGWIDQLTGLTRNMKHCGKKLDLVVESIINDHRQKRRFSRTKGGDEKDDEQDDFIDICLSIMEQPQLPGNNNPSQIPIKSIVLDMIGGGTDTTKLTTIWTLSLLLNNPHVLDKAKQEVDAHFRTKRRSTNDAAAAVVDFDDIRNLVYIQAIIKESMRLYPASPVVERLSGEDCVVGGFHVPAGTRLWANVWKMQRDPKVWDDPLVFRPDRFLSDEQKMVDVRGQNYELLPFGAGRRVCPGVSFSLDLMQLVLTRLILEFEMKSPSGKVDMTATPGLMSYKVIPLDILLTHRRIKPCVQSAASERDMESSGVPVITLGSGKVMPVLGMGTFEKVGKGSERERLAILKAIEVGYRYFDTAAAYETEEVLGEAIAEALQLGLVKSRDELFISSMLWCTDAHADRVLLALQNSLRNLKLEYVDLYMLPFPASLKPGKITMDIPEEDICRMDYRSVWAAMEECQNLGFTKSIGVSNFSCKKLQELMATANIPPAVNQVEMSPAFQQKKLREYCNANNILVSAISVLGSNGTPWGSNAVLGSEVLKKIAMAKGKSVAQVSMRWVYEQGASLVVKSFSEERLRENLNIFDWELTKEDHEKIGEIPQCRILSAYFLVSPNGPFKSQEELWDDEA

SEQ ID NO: 5 - protein, 900 aa, Papaver setigerum
MELQYISYFQPTSSVVALLLALVSILSSVVVLRKTFLNNYSSSPASSTKTAVLSHQRQQSCALPISGLLHIFMNKNGLIHVTLGNMADKYGPIFSFPTGSHRTLVVSSWEMVKECFTGNNDTAFSNRPIPLAFKTIFYACGGIDSYGLSSVPYGKYWRELRKVCVHNLLSNQQLLKFRHLIISQVDTSFNKLYELCKNSEDNQGNYTTTTTAAGMVRIDDWLAELSFNVIGRIVCGFQSGPKTGAPSRVEQFKEAINEASYFMSTSPVSDNVPMLGWIDQLTGLTRNMKHCGKKLDLVVESIINDHRQKRRFSRTKGGDEKDDEQDDFIDICLSIMEQPQLPGNNNPSQIPIKSIVLDMIGGGTDTTKLTTIWTLSLLLNNPHVLDKAKQEVDAHFRTKRRSTNDAAAAVVDFDDIRNLVYIQAIIKESMRLYPASPVVERLSGEDCVVGGFHVPAGTRLWANVWKMQRDPKVWDDPLVFRPDRFLSDEQKMVDVRGQNYELLPFGAGRRVCPGVSFSLDLMQLVLTRLILEFEMKSPSGKVDMTATPGLMSYKVIPLDILLTHRRIKPCVQSAASERDMESSGVPVITLGSGKVMPVLGMGTFEKVGKGSERERLAILKAIEVGYRYFDTAAAYETEEVLGEAIAEALQLGLVKSRDELFISSMLWCTDAHADRVLLALQNSLRNLKLEYVDLYMLPFPASLKPGKITMDIPEEDICRMDYRSVWAAMEECQNLGFTKSIGVSNFSCKKLQELMATANIPPAVNQVEMSPAFQQKKLREYCNANNILVSAISVLGSNGTPWGSNAVLGSEVLKKIAMAKGKSVAQVSMRWVYEQGASLVVKSFSEERLRENLNIFDWELTKEDHEKIGEIPQCRILSAYFLVSPNGPFKSQEELWDDEA

SEQ ID NO: 6 - protein, 724 aa, Papaver setigerum
MELQYISYFQPTSSVVALLLALVSILSSVVVLRKTFLNNYSSSPASSTKTAVLSHQRQQSCALPISGLLHIFMNKNGLIHVTLGNMADKYGPIFSFPTGSHRTLVVSSWEMVKECFTGNNDTAFSNRPIPLAFKTIFYACGGIDSYGLSSVPYGKYWRELRKVCVHNLLSNQQLLKFRHLIISQVDTSFNKLYELCKNSEDNQGNYTTTTTAAGMVRIDDWLAELSFNVIGRIVCGFQSGPKTGAPSRVEQFKEAINEASYFMSTSPVSDNVPMLGWIDQLTGLTRNMKHCGKKLDLVVESIINDHRQKRRFSRTKGGDEKDDEQDDFIDICLSIMEQPQLPGNNNPSQIPIKSIVLDMIGGGTDTTKLTTIWTLSLLLNNPHVLDKAKQEVDAHFRTKRRSTNDAAAAVVDFDDIRNLVYIQALYPASPVVERLSGEDCVVGGFHVPAGTRLWANVWKMQRDPKVWDDPLVFRPDRFLSDEQKMVDVRGQNYELLPFGAGRRVCPGVSFSLDLMQLVLTRLILEFEMKSPSGKVDMTATPGLMSYKVIPLDILLTHRRIKPCVQSAASERDMESSGVPVITLGSGKVMPVLGMGTFEKVGKGSERERLAILKAIEVGYRYFDTAAAYETEEVLGEAIAEALQLGLVKSRDELFISSMLWCTDAHADRVLLALQNSLRNLKLEYVDLYMLPFPASLKPGKITMDIPEEDICRMDYRSVWAAMEE

SEQ ID NO: 7 - protein, 889 aa, Papaver bracteatum
MELQYFSYFQPTSSVVALLLALVSILFSVVVLRKTFSNNYSSPASSTETAVLCHQRQQSCALPISGLLHVFMNKNGLIHVTLGNMADKYGPIFSFPTGSHRTLVVSSWEMVKECFTGNNDTAFSNRPIPLAFQTIFYACGGIDSYGLSSVPYGKYWRELRKVCVHNLLSNQQLLKFRHLIISQVDTSFNKLYELCKNSEDNQGMVRMDDWLAQLSFNVIGRIVCGFQSDPKTGAPSRVEQFKEVINEASYFMSTSPVSDNVPMLGWIDQLTGLTRNMKHCGKKLDLVVESIIKDHRQKRRFSRTKGGDEKDDEQDDFIDICLSIMEQPQLPGNNSPPQIPIKSIVLDMIGGGTDTTKLTTIWTLSLLLNNPHVLDKAKQEVDAHFRKKRRSTDDAAAAVVDFDDIRNLVYIQAIIKESMRLYPASPVVERLSGEDCVVGGFHVPAGTRLWANVWKMQRDPKVWDDPLVFRPERFLSDEQKMVDVRGQNYELLPFGAGRRICPGVSFSLDLMQLVLTRLILEFEMKSPSGKVDMTATPGLMSYKVVPLDILLTHRRIKSCVQLASSERDMESSGVPVITLSSGKVMPVLGMGTFEKVGKGSERERLAILKAIEVGYRYFDTAAAYETEEVLGEAIAEALQLGLIESRDELFISSMLWCTDAHPDRVLLALQNSLRNLKLEYLDLYMLPFPASLKPGKITMDIPEEDICRMDYRSVWSAMEECQNLGFTKSIGVSNFSSKKLQELMATANIPPAVNQVEMSPAFQQKKLREYCNANNILVSAVSILGSNGTPWGSNAVLGSEVLKQIAMAKGKSVAQVSMRWVYEQGASLVVKSFSEERLRENLNIFDWELTKEDNEKIGEIPQCRILTAYFLVSPNGPFKSQEELWDDKA

SEQ ID NO: 8 - protein, 889 aa, Papaver bracteatum
MELQYFSYFQPTSSVVALLLALVSILFSVVVLRKTFSNNYSSPASSTETAVLCHQRQQSCALPISGLLHVFMNKNGLIHVTLGNMADKYGPIFSFPTGSHRTLVVSSWEMVKECFTGNNDTAFSNRPIPLAFQTIFYACGGIDSYGLSSVPYGKYWRELRKVCVHNLLSNQQLLKFRHLIISQVDTSFNKLYELCKNSEDNQGMVRMDDWLAQLSFNVIGRIVCGFQSDPKTGAPSRVEQFKEVINEASYFMSTSPVSDNVPMLGWIDQLTGLTRNMKHCGKKLDLVVESIIKDHRQKRRFSRTKGGDEKDDEQDDFIDICLSIMEQPQLPGNNSPPQIPIKSIVLDMIGGGTDTTKLTTIWTLSLLLNNPHVLDKAKQEVDAHFRKKRRSTDDAAAAVVDFDDIRNLVYIQAIIKESMRLYPASPVVERLSGEDCVVGGFHVPAGTRLWANVWKMQRDPKVWDDPLVFRPERFLSDEQKMVDVRGQNYELLPFGAGRRICPGVSFSLDLMQLVLTRLILEFEMKSPSGKVDMTATPGLMSYKVVPLDILLTHRRIKSCVQLASSERDMESSGVPVITLSSGKVMPVLGMGTFEKVGKGSERERLAILKAIEVGYRYFDTAAAYETEEVLGEAIAEALQLGLIESRDELFISSMLWCTDAHPDRVLLALQNSLRNLKLEYLDLYMLPFPASLKPGKITMDIPEEDICRMDYRSVWSAMEECQNLGFTKSIGVSNFSCKKLQELMATANIPPAVNQVEMSPAFQQKKLREYCNANNILVSAVSILGSNGTPWGSNAVLGSEVLKQIAMAKGKSVAQVSMRWVYEQGASLVVKSFSEERLRENLNIFDWELTKEDNEKIGEIPQCRILTAYFLVSPNGPFKSQEELWDDKA

SEQ ID NO: 9 - protein, 848 aa, Papaver bracteatum
SSPASSTETAVLCHQRQQSCALPISGLLHIFMNKNGLIHVTLGNMADKYGPIFSFPTGSHRILVVSSWEMVKECFTGNNDTAFSNRPIPLAFKTIFYACRGIDSYGLSSVPYGKYWRELRKVCVHNLLSNQQLLKFRHLIISQVDTSFNKLYELCKNSEDNQGMVRMDDWLAQLSFSVIGRIVCGFQSDPKTGAPSRVEQFKEAINEASYFMSTSPVSDNVPMLGWIDQLTGLTRNMTHCGKKLDLVVESIINDHRQKRRFSRTKGGDEKDDEQDDFIDICLSIMEQPQLPGNNNPPKIPIKSIVLDMIGAGTDTTKLTIIWTLSLLLNNPNVLAKAKQEVDAHFETKKRSTNEASVVVDFDDIGNLVYIQAIIKESMRLYPVSPVVERLSSEDCVVGGFHVPAGTRLWANVWKMQRDPKVWDDPLVFRPERFLSDEQKMVDVRGQNYELLPFGAGRRICPGVSFSLDLMQLVLTRLILEFEMKSPSGKVDMTATPGLMSYKVVPLDILLTHRRIKSCVQLASSERDMESSGVPVITLRSGKVMPVLGMGTFEKAGKGSERERLAILKAIEVGYRYFDTAAAYETEEVLGEAIAEALQLGLIKSRDELFISSMLWCTDAHPDRVLLALQNSLRNLKLEYVDLYMLPFPASLKPGKITMDIPEEDICPMDYRSVWSAMEECQNLGLTKSIGVSNFSCKKLEELMATANIPPAVNQVEMSPAFQQKKLREYCNANNILVSAVSILGSNGTPWGSNAVLGSEVLKKIAMAKGKSVAQVSMRWVYEQGASLVVKSFSEERLRENLNIFDWQLTKEDNEKIGEIPQCRILSAYFLVSPKGPFKSQEELWDDKA

SEQ ID NO: 10 - protein, 847 aa, Papaver bracteatum
SSPASSTETAVLCHQRQQSCALPISGLLHIFMNKNGLIHVTLGNMADKYGPIFSFPTGSHRILVVSSWEMVKECFTGNNDTFFSNRPIPLAFKIIFYAGGVDSYGLALVPYGKYWRELRKICVHNLLSNQQLLKFRHLIISQVDTSFNKLYELCKNSEDNQGMVRMDDWLAQLSFSVIGRIVCGFQSDPKTGAPSRVEQFKEAINEASYFMSTSPVSDNVPMLGWIDQLTGLTRNMTHCGKKLDLVVESIINDHRQKRRFSRTKGGDEKDDEQDDFIDICLSIMEQPQLPGNNNPPKIPIKSIVLDMIGGGTDTTKLTTIWTLSLLLNNPHVLDKAKQEVDAHFLTKRRSTNDAAVVDFDDIRNLVYIQAIIKESMRLYPASPVVERLSGEDCVVGGFHVPAGTRLWVNVWKMQRDPNVWADPMVFRPERFLSHGQKKMVDVRGKNYELLPFGAGRRICPGISFSLDLMQLVLTRLILEFEMKSPSGKVDMTATPGLMSYKVVPLDILLTHRRIKSCVQLASSERDMESSGVPVITLRSGKVMPVLGMGTFEKAGKGSERERLAILKAIEVGYRYFDTAAAYETEEVLGEAIAEALQLGLIKSRDELFISSMLWCTDAHPDRVLLALQNSLRNLKLEYVDLYMLPFPASLKPGKITMDIPEEDICPMDYRSVWSAMEECQNLGLTKSIGVSNFSCKKLEELMATANIPPAVNQVEMSPAFQQKKLREYCNANNILVSAVSILGSNGTPWGSNAVLGSEVLKKIAMAKGKSVAQVSMRWVYEQGASLVVKSFSEERLRENLNIFDWQLTKEDNEKIGEIPQCRILSAYFLVSPKGPFKSQEELWDDKA

SEQ ID NO: 11 - protein, 845 aa, Papaver bracteatum
SSPASSTETAVLCHQRQQSCALPISGLLHIFMNKNGLIHVTLGNMADKYGPIFSFPTGSHRILVVSSWEMVKECFTGNNDTFFSNRPIPLAFKIIFYAGGVDSYGLALVPYGKYWRELRKICVHNLLSNQQLLNFRHLIISQVDTSFNKLYDLSNKKKNTTTDSGTVRMDDWLAQLSFNVIGRIVCGFQTHTETSATSSVERFTEAIDEASRFMSIATVSDTFPWLGWIDQLTGLTRKMKHYGKKLDLVVESIIEDHRQNRRISGTKQGDDFIDICLSIMEQPQIIPGNNDPPRQIPIKSIVLDMIGGGTDTTKLTTTWTLSLLLNNPHVLEKAREEVDAHFGTKRRPTNDDAVMVEFDDIRNLVYIQAIIKESMRLYPASPVVERLSGEDCVVGGFHVPAGTRLWVNVWKMQRDPNVWADPMVFRPERFLSDEQKMVDVRGQNYELLPFGAGRRICPGVSFSLDLMQLVLTRLILEFEMKSPSGKVDMTATPGLMSYKVVPLDILLTHRRIKSCVQLASSERDMESSGVPVITLRSGKVMPVLGMGTFEKAGKGSERERLAILKAIEVGYRYFDTAAAYETEEVLGEAIAEALQLGLIKSRDELFISSMLWCTDAHPDRVLLALQNSLRNLKLEYVDLYMLPFPASLKPGKITMDIPEEDICPMDYRSVWSAMEECQNLGLTKSIGVSNFSCKKLEELMATANIPPAVNQVEMSPAFQQKKLREYCNANNILVSAVSILGSNGTPWGSNAVLGSEVLKKIAMAKGKSVAQVSMRWVYEQGASLVVKSFSEERLRENLNIFDWQLTKEDNEKIGEIPQCRILSAYFLVSPKGPFKSQEELWDDKA

SEQ ID NO: 12 - protein, 869 aa, Papaver bracteatum
VALRKKILKNYYSSSSSTATAVSHQWPKASRALPLIDLLHVFFNKTDLMHVTLGNMADKFGPIFSFPTGSHRTLVVSSWEKAKECFTGNNDIVFSGRPLPLAFKLIFYAGGIDSYGISQVPYGKKWRELRNICVHNILSNQQLLKFRHLMISQVDNSFNKLYEVCNSNKDEGDSATSTTAAGIVRMDDWLGKLAFDVIARIVCGFQSQTETSTTSSMERFTEAMDEASRFMSVTAVSDTVPWLGWIDQLTGLKRNMKHCGKKLNLVVKSIIEDHRQKRRLSSTKKGDENIIDEDEQDDFIDICLSIMEQPQLPGNNNPPKIPIKSIVLDMIGGGTDTTKLTTIWTLSLLLNNPHVLDKAKQEVDAHFLTKRRSTNDAAVVDFDDIRNLVYIQAIIKESMRLYPASPVVERLSGEDCVVGGFHVPAGTRLWVNVWKMQRDPNVWADPMVFRPERFLSDEQKMVDVRGQNYELLPFGAGRRICPGVSFSLDLMQLVLTRLILEFEMKSPSGKVDMTATPGLMSYKVVPLDILLTHRRIKSCVQLASSERDMESSGVPVITLRSGKVMPVLGMGTFEKAGKGSERERLAILKAIEVGYRYFDTAAAYETEEVLGEAIAEALQLGLIKSRDELFISSMLWCTDAHPDRVLLALQNSLRNLKLEYVDLYMLPFPASLKPGKITMDIPEEDICPMDYRSVWSAMEECQNLGLTKSIGVSNFSCKKLEELMATANIPPAVNQVEMSPAFQQKKLREYCNANNILVSAVSILGSNGTPWGSNAVLGSEVLKKIAMAKGKSVAQVSMRWVYEQGASLVVKSFSEERLRENLNIFDWQLTKEDNEKIGEIPQCRILSAYFLVSPKGPFKSQEELWDDKA

SEQ ID NO: 13 - protein, 858 aa, Papaver bracteatum
  MOD_RES (822)..(822): Any amino acid
MELQYFSYFQPTSSVVALLLALVSILFSVVVLRKTFSNNYSSPASSTETAVLCHQRQQSCALPISGLLHVFMNKNGLIHVTLGNMADKYGPIFSFPTGSHRTLVVSSWEMVKECFTGNNDTAFSNRPIPLAFQTIFYACGGIDSYGLSSVPYGKYWRELRKVCVHNLLSNQQLLKFRHLIISQVDTSFNKLYELCKNSEDNQGMVRMDDWLAQLSFNVIGRIVCGFQSDPKTGAPSRVEQFKEVINEASYFMSTSPVSDNVPMLGWIDQLTGLTRNMKHCGKKLDLVVESIIKDHRQKRRFSRTKGGDEKDDEQDDFIDICLSIMEQPQLPGNNSPPQIPIKSIVLDMIGGGTDTTKLTTIWTLSLLLNNPHVLDKAKQEVDAHFRKKRRSTDDAAAAVVDFDDIRNLVYIQAIIKESMRLYPASPVVERLSGEDCVVGGFHVPAGTRLWANVWKMQRDPKVWDDPLVFRPERFLSDEQKMVDVRGQNYELLPFGAGRRICPGVSFSLDLMQLVLTRLILEFEMKSPSGKVDMTATPGLMSYKVVPLDILLTHRRIKSCVQLASSERDMESSGVPVITLSSGKVMPVLGMGTFEKVGKGSERERLAILKAIEVGYRYFDTAAAYETEEVLGEAIAEALQLGLIESRDELFISSMLWCTDAHPDRVLLALQNSLRNLKLEYLDLYMLPFPASLKPGKITMDIPEEDICRMDYRSVWSAMEECQNLGFTKSIGVSNFSSKKLQELMATANIPPAVNQVEMSPAFQQKKLREYCNANNILVSAVSILGSNGTPWGSNAVLGSEVLKQIAMAKGKSVAQVSMRWVXKFSAYAIVWSLFFGHRICITLYSFLIRNVAYICITY

SEQ ID NO: 14 - protein, 716 aa, Papaver bracteatum
MELQYFSYFQPTSSVVALLLALVSILFSVVVLRKTFSNNYSSPASSTETAVLCHQRQQSCALPISGLLHVFMNKNGLIHVTLGNMADKYGPIFSFPTGSHRTLVVSSWEMVKECFTGNNDTAFSNRPIPLAFQTIFYACGGIDSYGLSSVPYGKYWRELRKVCVHNLLSNQQLLKFRHLIISQVDTSFNKLYELCKNSEDNQGMVRMDDWLAQLSFNVIGRIVCGFQSDPKTGAPSRVEQFKEVINEASYFMSTSPVSDNVPMLGWIDQLTGLTRNMKHCGKKLDLVVESIIKDHRQKRRFSRTKGGDEKDDEQDDFIDICLSIMEQPQLPGNNSPPQIPIKSIVLDMIGGGTDTTKLTTIWTLSLLLNNPHVLDKAKQEVDAHFRKKRRSTDDAAAAVVDFDDIRNLVYIQAIIKESMRLYPASPVVERLSGEDCVVGGFHVPAGTRLWANVWKMQRDPKVWDDPLVFRPERFLSDEQKMVDVRGQNYELLPFGAGRRICPGVSFSLDLMQLVLTRLILEFEMKSPSGKVDMTATPGLMSYKVVPLDILLTHRRIKSCVQLASSERDMESSGVPVITLSSGKVMPVLGMGTFEKVGKGSERERLAILKAIEVGYRYFDTAAAYETEEVLGEAIAEALQLGLIESRDELFISSMLWCTDAHPDRVLLALQNSLRQVFLMQIRLIYICTYQQVHLNIYFQINEFVLCDMYRNLKLEY

SEQ ID NO: 15 - protein, 864 aa, Chelidonium majus
LNNYSSSPASSTKTAVLSHQRQQSCALPISGLLHIFMNKNGLIHVTLGNMADKYGPIFSFPTGSHRTLVVSSWEMVKECFTGNNDTAFSNRPIPLAFKTIFYACGGIDSYGLSSVPYGKYWRELRKVCVHNLLSNQQLLKFRHLIISQVDTSFNKLYELCKNSEDNQGNYPTTTTAAGMVRIDDWLAELSFNVIGRIVCGFQSGPKTGAPSRVEQFKEAINEASYFMSTSPVSDNVPMLGWIDQLTGLTRNMKHCGKKLDLVVESIINDHRQKRRFSRTKGGDEKDDEQDDFIDICLSIMEQPQLPGNNNPSQIPIKSIVLDMIGGGTDTTKLTTIWTLSLLLNNPHVLDKAKQEVDAHFRTKRRSTNDAAAAVVDFDDIRNLVYIQAIIKESMRLYPASPVVERLSGEDCVVGGFHVPAGTRLWANVWKMQRDPKVWDDPLVFRPDRFLSDEQKMVDVRGQNYELLPFGAGRRVCPGVSFSLDLMQLVLTRLILEFEMKSPSGKVDMTATPGLMSYKVIPLDILLTHRRIKPCVQSAASERDMESSGVPVITLGSGKVMPVLGMGTFEKVGKGSERERLAFLKAIEVGYRYFDTAAAYETEEFLGEAIAEALQLGLIKSRDELFITSKLWPCDAHPDLVVPALQNSLRNLKLEYVDLYMLPFPASLKPGKITMDIPEEDICRMDYRSVWAAMEECQNLGFTKSIGVSNFSCKKLQELMATANIPPAVNQVEMSPAFQQKKLREYCNANNILVSAISVLGSNGTPWGSNAVLGSEVLKKIAMAKGKSVAQVSMRWVYEQGASLVVKSFSEERLRENLNIFDWELTKEDHEKIGEIPQCRILSAYFLVSPNGPFKSQEELWDDEA

SEQ ID NO: 16 - protein, 889 aa, Artificial Sequence; identical to SEQ ID NO: 8
  Description of Artificial Sequence: Synthetic polypeptide

SEQ ID NO: 17 - protein, 568 aa, Artificial Sequence
  Description of Artificial Sequence: Synthetic polypeptide
MELQYFSYFQPTSSVVALLLALVSILFSVVVLRKTFSNNYSSPASSTETAVLCHQRQQSCALPISGLLHVFMNKNGLIHVTLGNMADKYGPIFSFPTGSHRTLVVSSWEMVKECFTGNNDTAFSNRPIPLAFQTIFYACGGIDSYGLSSVPYGKYWRELRKVCVHNLLSNQQLLKFRHLIISQVDTSFNKLYELCKNSEDNQGMVRMDDWLAQLSFNVIGRIVCGFQSDPKTGAPSRVEQFKEVINEASYFMSTSPVSDNVPMLGWIDQLTGLTRNMKHCGKKLDLVVESIIKDHRQKRRFSRTKGGDEKDDEQDDFIDICLSIMEQPQLPGNNSPPQIPIKSIVLDMIGGGTDTTKLTTIWTLSLLLNNPHVLDKAKQEVDAHFRKKRRSTDDAAAAVVDFDDIRNLVYIQAIIKESMRLYPASPVVERLSGEDCVVGGFHVPAGTRLWANVWKMQRDPKVWDDPLVFRPERFLSDEQKMVDVRGQNYELLPFGAGRRICPGVSFSLDLMQLVLTRLILEFEMKSPSGKVDMTATPGLMSYKVVPLDILLTHRRIKSCVQLASSERD

SEQ ID NO: 18 - protein, 321 aa, Artificial Sequence
  Description of Artificial Sequence: Synthetic polypeptide
MESSGVPVITLSSGKVMPVLGMGTFEKVGKGSERERLAILKAIEVGYRYFDTAAAYETEEVLGEAIAEALQLGLIESRDELFISSMLWCTDAHPDRVLLALQNSLRNLKLEYLDLYMLPFPASLKPGKITMDIPEEDICRMDYRSVWSAMEECQNLGFTKSIGVSNFSCKKLQELMATANIPPAVNQVEMSPAFQQKKLREYCNANNILVSAVSILGSNGTPWGSNAVLGSEVLKQIAMAKGKSVAQVSMRWVYEQGASLVVKSFSEERLRENLNIFDWELTKEDNEKIGEIPQCRILTAYFLVSPNGPFKSQEELWDDKA

SEQ ID NO: 19 - DNA, 682 bp, Saccharomyces cerevisiae
ttcagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaa

SEQ ID NO: 20 - DNA, 289 bp, Saccharomyces cerevisiae
gagcgttggttggtggatcaagcccacgcgtaggcaatcctcgagcagatccgccaggcgtgtatatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggacctttgcagcataaattactatacttctatagacacacaaacacaaatacacacactaaattaata

SEQ ID NO: 21 - DNA, 413 bp, Saccharomyces cerevisiae
catagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaa

SEQ ID NO: 22 - DNA, 274 bp, Saccharomyces cerevisiae
acaggccccttttcctttgtcgatatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttg

SEQ ID NO: 23 - DNA, 150 bp, Saccharomyces cerevisiae
gcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggta

SEQ ID NO: 24 - DNA, 8014 bp, Artificial Sequence
  Description of Artificial Sequence: Synthetic polynucleotide
cctcgccgcagttaattaaagtcagtgagcgaggaagcgcgtaactataacggtcctaaggtagcgaatcctgatgcggtattttctccttacgcatctgtgcggtatttcacaccgcatagatcggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctttcggggctctcttgccttccaacccagtcagaaatcgagttccaatccaaaagttcacctgtcccacctgcttctgaatcaaacaagggaataaacgaatgaggtttctgtgaagctgcactgagtagtatgttgcagtcttttggaaatacgagtcttttaataactggcaaaccgaggaactcttggtattcttgccacgactcatctccatgcagttggacgatatcaatgccgtaatcattgaccagagccaaaacatcctccttaagttgattacgaaacacgccaaccaagtatttcggagtgcctgaactatttttatatgcttttacaagacttgaaattttccttgcaataaccgggtcaattgttctctttctattgggcacacatataatacccagcaagtcagcatcggaatctagagcacattctgcggcctctgtgctctgcaagccgcaaactttcaccaatggaccagaactacctgtgaaattaataacagacatactccaagctgcctttgtgtgcttaatcacgtatactcacgtgctcaatagtcaccaatgccctccctcttggccctctccttttcttttttcgaccgaattaattcttaatcggcaaaaaaagaaaagctccggatcaagattgtacgtaaggtgacaagctatttttcaataaagaatatcttccactactgccatctggcgtcataactgcaaagtacacatatattacgatgctgttctattaaatgcttcctatattatatatatagtaatgtcgtgatctatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaaggtgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggacgcgtagtctagaccagccaggacagaaatgcctcgacttcgctgctacccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacattatgagggaagcggtgatcgccgaagtatcgactcaactatcagaggtagttggcgccatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccggctgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagcattcaaggcgccttgattatttgacgtggtttgatggcctccacgcacgttgtgatatgtagatgattcagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaaatggaacttcagtacttctcctattttcaacccacttcatctgtcgtagccctactactagcactagtgagtattttatttagcgtagttgttttgaggaagactttcagtaacaattactccagccccgcgtcaagtacggaaaccgctgtgctgtgtcatcagaggcaacagagttgcgccctacctatcagcggccttcttcacgtgttcatgaataagaacggcctgattcatgtcaccttgggaaatatggctgacaaatatggccctatcttcagttttccgacaggcagccaccgtactttagtagtcagttcctgggaaatggtgaaagagtgtttcaccggtaataacgacacggcattctccaacagaccaatccctttggcttttcaaaccatattctacgcctgtggcggcattgattcttacggtttaagtagtgtcccgtatggtaaatactggagggagttgagaaaggtgtgtgttcacaacctgctgagtaatcagcaattgctgaagttcagacatcttataatctcccaagtggatacgtcttttaacaagttgtatgagctgtgtaagaactctgaagataatcaaggtatggtaaggatggatgattggctagctcaactttcctttaacgtcatcggtaggatcgtttgcggattccagtctgacccaaagacgggtgcaccttcaagggtagaacagtttaaggaagtcataaatgaggcgtcatattttatgtcaacaagtccagtctccgataacgtaccaatgttgggatggatcgaccaattgaccggtctgacgaggaacatgaagcattgtgggaagaagcttgacttagtagtggagtcaattatcaaggaccataggcaaaagagacgtttttcacgtacaaaaggtggcgatgagaaggatgacgaacaggacgactttattgatatttgcttgagcatcatggagcagccacagttgcccgggaacaattctccccctcaaattccgatcaaatctatcgtgctagacatgattgggggtggtaccgacactacgaaacttacaaccatatggaccctatcacttttgttgaacaatcctcacgtgttagataaagctaaacaagaggtcgacgctcactttcgtaaaaagagaagatcaacagatgacgcagcagcggcagtcgttgattttgacgacataagaaatttagtatacatccaagccatcattaaagaaagtatgaggctttatccagccagcccggtggttgagcgtctttccggcgaggattgcgttgttggaggttttcacgtgcctgctggtacgagactatgggctaacgtttggaagatgcaaagagatcccaaagtttgggacgatcctctagtattcagacctgaaaggtttttgagcgacgagcaaaagatggtagacgttcgtggccaaaactatgaacttctgccattcggcgcaggaagaagaatctgtccaggcgtttcctttagtcttgaccttatgcaacttgtcctaaccaggttaatcctagagttcgaaatgaagtccccgtccggcaaggtagatatgaccgcaactccaggactaatgtcttacaaggtggttccattggacatattgctgactcaccgtcgtatcaagtcatgcgttcaattggcgtcttctgaacgtgatatggaaagttctggggtgcctgtgatcacattgtcctcaggtaaagtaatgcccgtactgggcatgggaaccttcgaaaaggtgggtaaggggtctgaacgtgagcgtttagccattcttaaagcgatcgaagttggttaccgttactttgataccgcagcggcatatgaaacggaagaagttctaggggaagccattgctgaagctttacaattgggtctgatagagagccgtgacgagctgttcatcagctcaatgctttggtgcaccgacgcacatccagaccgtgtgctacttgctctgcaaaacagtctgagaaatctaaaacttgaatatctagacctatatatgttgccgtttcctgccagccttaagccgggcaaaattacgatggatattcctgaggaggatatttgccgtatggattatcgttcagtctggagcgccatggaagagtgtcaaaacttaggatttactaaaagtattggtgtaagcaacttttcttgcaagaaattacaagaattaatggccactgcaaatatcccgcccgcggtaaatcaagtagagatgtcaccagctttccaacagaaaaaactgagggaatattgtaacgcaaacaacatattggtatccgcagtaagcattctgggatcaaacgggacgccctggggtagtaatgctgttcttggaagcgaagttttgaaacagatcgcgatggcgaaaggcaaaagcgttgcgcaagtcagtatgaggtgggtctatgagcagggcgcgtctttagtagtcaagagtttctctgaagaacgtttaagagaaaacctgaatatttttgactgggagcttacgaaagaagacaatgagaagataggcgaaatcccgcaatgtagaatccttactgcgtacttccttgtctccccgaacggcccgtttaaatctcaggaagagctttgggatgacaaggcataaacaggccccttttcctttgtcgatatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgtaatcattatcactttacgggtcctttccggtgatccgacaggttacggggcggcgacctcgcgggttttcgctatttatgaaaattttccggtttaaggcgtttccgttcttcttcgtcataacttaatgtttttatttaaaatacctcgcgagtggcaacactgaaaatacccatggagcggcgtaaccgtcgcacaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcagtggaacgtgcattatgaattagttacgctagggataacagggtaatatagaacccgaacgaccgagcgcagcggcggccgcgctgataccgccgc

SEQ ID NO: 25 - DNA, 7621 bp, Artificial Sequence
  Description of Artificial Sequence: Synthetic polynucleotide
cctcgccgcagttaattaaagtcagtgagcgaggaagcgcgtaactataacggtcctaaggtagcgaatcctgatgcggtattttctccttacgcatctgtgcggtatttcacaccgcatagatcggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctttcggggctctcttgccttccaacccagtcagaaatcgagttccaatccaaaagttcacctgtcccacctgcttctgaatcaaacaagggaataaacgaatgaggtttctgtgaagctgcactgagtagtatgttgcagtcttttggaaatacgagtcttttaataactggcaaaccgaggaactcttggtattcttgccacgactcatctccatgcagttggacgatatcaatgccgtaatcattgaccagagccaaaacatcctccttaagttgattacgaaacacgccaaccaagtatttcggagtgcctgaactatttttatatgcttttacaagacttgaaattttccttgcaataaccgggtcaattgttctctttctattgggcacacatataatacccagcaagtcagcatcggaatctagagcacattctgcggcctctgtgctctgcaagccgcaaactttcaccaatggaccagaactacctgtgaaattaataacagacatactccaagctgcctttgtgtgcttaatcacgtatactcacgtgctcaatagtcaccaatgccctccctcttggccctctccttttcttttttcgaccgaattaattcttaatcggcaaaaaaagaaaagctccggatcaagattgtacgtaaggtgacaagctatttttcaataaagaatatcttccactactgccatctggcgtcataactgcaaagtacacatatattacgatgctgttctattaaatgcttcctatattatatatatagtaatgtcgtgatctatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaaggtgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggacgcgtagtctagaccagccaggacagaaatgcctcgacttcgctgctacccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacattatgagggaagcggtgatcgccgaagtatcgactcaactatcagaggtagttggcgccatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccggctgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagcattcaaggcgccttgattatttgacgtggtttgatggcctccacgcacgttgtgatatgtagatgagagcgttggttggtggatcaagcccacgcgtaggcaatcctcgagcagatccgccaggcgtgtatatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggacctttgcagcataaattactatacttctatagacacacaaacacaaatacacacactaaattaataatggaacttcagtacttctcctattttcaacccacttcatctgtcgtagccctactactagcactagtgagtattttatttagcgtagttgttttgaggaagactttcagtaacaattactccagccccgcgtcaagtacggaaaccgctgtgctgtgtcatcagaggcaacagagttgcgccctacctatcagcggccttcttcacgtgttcatgaataagaacggcctgattcatgtcaccttgggaaatatggctgacaaatatggccctatcttcagttttccgacaggcagccaccgtactttagtagtcagttcctgggaaatggtgaaagagtgtttcaccggtaataacgacacggcattctccaacagaccaatccctttggcttttcaaaccatattctacgcctgtggcggcattgattcttacggtttaagtagtgtcccgtatggtaaatactggagggagttgagaaaggtgtgtgttcacaacctgctgagtaatcagcaattgctgaagttcagacatcttataatctcccaagtggatacgtcttttaacaagttgtatgagctgtgtaagaactctgaagataatcaaggtatggtaaggatggatgattggctagctcaactttcctttaacgtcatcggtaggatcgtttgcggattccagtctgacccaaagacgggtgcaccttcaagggtagaacagtttaaggaagtcataaatgaggcgtcatattttatgtcaacaagtccagtctccgataacgtaccaatgttgggatggatcgaccaattgaccggtctgacgaggaacatgaagcattgtgggaagaagcttgacttagtagtggagtcaattatcaaggaccataggcaaaagagacgtttttcacgtacaaaaggtggcgatgagaaggatgacgaacaggacgactttattgatatttgcttgagcatcatggagcagccacagttgcccgggaacaattctccccctcaaattccgatcaaatctatcgtgctagacatgattgggggtggtaccgacactacgaaacttacaaccatatggaccctatcacttttgttgaacaatcctcacgtgttagataaagctaaacaagaggtcgacgctcactttcgtaaaaagagaagatcaacagatgacgcagcagcggcagtcgttgattttgacgacataagaaatttagtatacatccaagccatcattaaagaaagtatgaggctttatccagccagcccggtggttgagcgtctttccggcgaggattgcgttgttggaggttttcacgtgcctgctggtacgagactatgggctaacgtttggaagatgcaaagagatcccaaagtttgggacgatcctctagtattcagacctgaaaggtttttgagcgacgagcaaaagatggtagacgttcgtggccaaaactatgaacttctgccattcggcgcaggaagaagaatctgtccaggcgtttcctttagtcttgaccttatgcaacttgtcctaaccaggttaatcctagagttcgaaatgaagtccccgtccggcaaggtagatatgaccgcaactccaggactaatgtcttacaaggtggttccattggacatattgctgactcaccgtcgtatcaagtcatgcgttcaattggcgtcttctgaacgtgatatggaaagttctggggtgcctgtgatcacattgtcctcaggtaaagtaatgcccgtactgggcatgggaaccttcgaaaaggtgggtaaggggtctgaacgtgagcgtttagccattcttaaagcgatcgaagttggttaccgttactttgataccgcagcggcatatgaaacggaagaagttctaggggaagccattgctgaagctttacaattgggtctgatagagagccgtgacgagctgttcatcagctcaatgctttggtgcaccgacgcacatccagaccgtgtgctacttgctctgcaaaacagtctgagaaatctaaaacttgaatatctagacctatatatgttgccgtttcctgccagccttaagccgggcaaaattacgatggatattcctgaggaggatatttgccgtatggattatcgttcagtctggagcgccatggaagagtgtcaaaacttaggatttactaaaagtattggtgtaagcaacttttcttgcaagaaattacaagaattaatggccactgcaaatatcccgcccgcggtaaatcaagtagagatgtcaccagctttccaacagaaaaaactgagggaatattgtaacgcaaacaacatattggtatccgcagtaagcattctgggatcaaacgggacgccctggggtagtaatgctgttcttggaagcgaagttttgaaacagatcgcgatggcgaaaggcaaaagcgttgcgcaagtcagtatgaggtgggtctatgagcagggcgcgtctttagtagtcaagagtttctctgaagaacgtttaagagaaaacctgaatatttttgactgggagcttacgaaagaagacaatgagaagataggcgaaatcccgcaatgtagaatccttactgcgtacttccttgtctccccgaacggcccgtttaaatctcaggaagagctttgggatgacaaggcataaacaggccccttttcctttgtcgatatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgtaatcattatcactttacgggtcctttccggtgatccgacaggttacggggcggcgacctcgcgggttttcgctatttatgaaaattttccggtttaaggcgtttccgttcttcttcgtcataacttaatgtttttatttaaaatacctcgcgagtggcaacactgaaaatacccatggagcggcgtaaccgtcgcacaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcagtggaacgtgcattatgaattagttacgctagggataacagggtaatatagaacccgaacgaccgagcgcagcggcggccgcgctgataccgccgc

SEQ ID NO: 26 - DNA, 8187 bp, Artificial Sequence
  Description of Artificial Sequence: Synthetic polynucleotide
cctcgccgcagttaattaaagtcagtgagcgaggaagcgcgtaactataacggtcctaaggtagcgaatcctgatgcggtattttctccttacgcatctgtgcggtatttcacaccgcatagatcggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctttcggggctctcttgccttccaacccagtcagaaatcgagttccaatccaaaagttcacctgtcccacctgcttctgaatcaaacaagggaataaacgaatgaggtttctgtgaagctgcactgagtagtatgttgcagtcttttggaaatacgagtcttttaataactggcaaaccgaggaactcttggtattcttgccacgactcatctccatgcagttggacgatatcaatgccgtaatcattgaccagagccaaaacatcctccttaagttgattacgaaacacgccaaccaagtatttcggagtgcctgaactatttttatatgcttttacaagacttgaaattttccttgcaataaccgggtcaattgttctctttctattgggcacacatataatacccagcaagtcagcatcggaatctagagcacattctgcggcctctgtgctctgcaagccgcaaactttcaccaatggaccagaactacctgtgaaattaataacagacatactccaagctgcctttgtgtgcttaatcacgtatactcacgtgctcaatagtcaccaatgccctccctcttggccctctccttttcttttttcgaccgaattaattcttaatcggcaaaaaaagaaaagctccggatcaagattgtacgtaaggtgacaagctatttttcaataaagaatatcttccactactgccatctggcgtcataactgcaaagtacacatatattacgatgctgttctattaaatgcttcctatattatatatatagtaatgtcgtgatctatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaaggtgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggacgcgtagtctagaccagccaggacagaaatgcctcgacttcgctgctacccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacattatgagggaagcggtgatcgccgaagtatcgactcaactatcagaggtagttggcgccatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccggctgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagcattcaaggcgccttgattatttgacgtggtttgatggcctccacgcacgttgtgatatgtagatgagagcgttggttggtggatcaagcccacgcgtaggcaatcctcgagcagatccgccaggcgtgtatatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggacctttgcagcataaattactatacttctatagacacacaaacacaaatacacacactaaattaataatggaacttcagtacttctcctattttcaacccacttcatctgtcgtagccctactactagcactagtgagtattttatttagcgtagttgttttgaggaagactttcagtaacaattactccagccccgcgtcaagtacggaaaccgctgtgctgtgtcatcagaggcaacagagttgcgccctacctatcagcggccttcttcacgtgttcatgaataagaacggcctgattcatgtcaccttgggaaatatggctgacaaatatggccctatcttcagttttccgacaggcagccaccgtactttagtagtcagttcctgggaaatggtgaaagagtgtttcaccggtaataacgacacggcattctccaacagaccaatccctttggcttttcaaaccatattctacgcctgtggcggcattgattcttacggtttaagtagtgtcccgtatggtaaatactggagggagttgagaaaggtgtgtgttcacaacctgctgagtaatcagcaattgctgaagttcagacatcttataatctcccaagtggatacgtcttttaacaagttgtatgagctgtgtaagaactctgaagataatcaaggtatggtaaggatggatgattggctagctcaactttcctttaacgtcatcggtaggatcgtttgcggattccagtctgacccaaagacgggtgcaccttcaagggtagaacagtttaaggaagtcataaatgaggcgtcatattttatgtcaacaagtccagtctccgataacgtaccaatgttgggatggatcgaccaattgaccggtctgacgaggaacatgaagcattgtgggaagaagcttgacttagtagtggagtcaattatcaaggaccataggcaaaagagacgtttttcacgtacaaaaggtggcgatgagaaggatgacgaacaggacgactttattgatatttgcttgagcatcatggagcagccacagttgcccgggaacaattctccccctcaaattccgatcaaatctatcgtgctagacatgattgggggtggtaccgacactacgaaacttacaaccatatggaccctatcacttttgttgaacaatcctcacgtgttagataaagctaaacaagaggtcgacgctcactttcgtaaaaagagaagatcaacagatgacgcagcagcggcagtcgttgattttgacgacataagaaatttagtatacatccaagccatcattaaagaaagtatgaggctttatccagccagcccggtggttgagcgtctttccggcgaggattgcgttgttggaggttttcacgtgcctgctggtacgagactatgggctaacgtttggaagatgcaaagagatcccaaagtttgggacgatcctctagtattcagacctgaaaggtttttgagcgacgagcaaaagatggtagacgttcgtggccaaaactatgaacttctgccattcggcgcaggaagaagaatctgtccaggcgtttcctttagtcttgaccttatgcaacttgtcctaaccaggttaatcctagagttcgaaatgaagtccccgtccggcaaggtagatatgaccgcaactccaggactaatgtcttacaaggtggttccattggacatattgctgactcaccgtcgtatcaagtcatgcgttcaattggcgtcttctgaacgtgattaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtacatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaaatggaaagttctggggtgcctgtgatcacattgtcctcaggtaaagtaatgcccgtactgggcatgggaaccttcgaaaaggtgggtaaggggtctgaacgtgagcgtttagccattcttaaagcgatcgaagttggttaccgttactttgataccgcagcggcatatgaaacggaagaagttctaggggaagccattgctgaagctttacaattgggtctgatagagagccgtgacgagctgttcatcagctcaatgctttggtgcaccgacgcacatccagaccgtgtgctacttgctctgcaaaacagtctgagaaatctaaaacttgaatatctagacctatatatgttgccgtttcctgccagccttaagccgggcaaaattacgatggatattcctgaggaggatatttgccgtatggattatcgttcagtctggagcgccatggaagagtgtcaaaacttaggatttactaaaagtattggtgtaagcaacttttcttgcaagaaattacaagaattaatggccactgcaaatatcccgcccgcggtaaatcaagtagagatgtcaccagctttccaacagaaaaaactgagggaatattgtaacgcaaacaacatattggtatccgcagtaagcattctgggatcaaacgggacgccctggggtagtaatgctgttcttggaagcgaagttttgaaacagatcgcgatggcgaaaggcaaaagcgttgcgcaagtcagtatgaggtgggtctatgagcagggcgcgtctttagtagtcaagagtttctctgaagaacgtttaagagaaaacctgaatatttttgactgggagcttacgaaagaagacaatgagaagataggcgaaatcccgcaatgtagaatccttactgcgtacttccttgtctccccgaacggcccgtttaaatctcaggaagagctttgggatgacaaggcataaacaggccccttttcctttgtcgatatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgtaatcattatcactttacgggtcctttccggtgatccgacaggttacggggcggcgacctcgcgggttttcgctatttatgaaaattttccggtttaaggcgtttccgttcttcttcgtcataacttaatgtttttatttaaaatacctcgcgagtggcaacactgaaaatacccatggagcggcgtaaccgtcgcacaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcagtggaacgtgcattatgaattagttacgctagggataacagggtaatatagaacccgaacgaccgagcgcagcggcggccgcgctgataccgccgc

SEQ ID NO: 27 - DNA, 8580 bp, Artificial Sequence
  Description of Artificial Sequence: Synthetic polynucleotide
cctcgccgcagttaattaaagtcagtgagcgaggaagcgcgtaactataacggtcctaaggtagcgaatcctgatgcggtattttctccttacgcatctgtgcggtatttcacaccgcatagatcggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctttcggggctctcttgccttccaacccagtcagaaatcgagttccaatccaaaagttcacctgtcccacctgcttctgaatcaaacaagggaataaacgaatgaggtttctgtgaagctgcactgagtagtatgttgcagtcttttggaaatacgagtcttttaataactggcaaaccgaggaactcttggtattcttgccacgactcatctccatgcagttggacgatatcaatgccgtaatcattgaccagagccaaaacatcctccttaagttgattacgaaacacgccaaccaagtatttcggagtgcctgaactatttttatatgcttttacaagacttgaaattttccttgcaataaccgggtcaattgttctctttctattgggcacacatataatacccagcaagtcagcatcggaatctagagcacattctgcggcctctgtgctctgcaagccgcaaactttcaccaatggaccagaactacctgtgaaattaataacagacatactccaagctgcctttgtgtgcttaatcacgtatactcacgtgctcaatagtcaccaatgccctccctcttggccctctccttttcttttttcgaccgaattaattcttaatcggcaaaaaaagaaaagctccggatcaagattgtacgtaaggtgacaagctatttttcaataaagaatatcttccactactgccatctggcgtcataactgcaaagtacacatatattacgatgctgttctattaaatgcttcctatattatatatatagtaatgtcgtgatctatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaaggtgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggacgcgtagtctagaccagccaggacagaaatgcctcgacttcgctgctacccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacattatgagggaagcggtgatcgccgaagtatcgactcaactatcagaggtagttggcgccatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccggctgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagcattcaaggcgccttgattatttgacgtggtttgatggcctccacgcacgttgtgatatgtagatgattcagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaaatggaacttcagtacttctcctattttcaacccacttcatctgtcgtagccctactactagcactagtgagtattttatttagcgtagttgttttgaggaagactttcagtaacaattactccagccccgcgtcaagtacggaaaccgctgtgctgtgtcatcagaggcaacagagttgcgccctacctatcagcggccttcttcacgtgttcatgaataagaacggcctgattcatgtcaccttgggaaatatggctgacaaatatggccctatcttcagttttccgacaggcagccaccgtactttagtagtcagttcctgggaaatggtgaaagagtgtttcaccggtaataacgacacggcattctccaacagaccaatccctttggcttttcaaaccatattctacgcctgtggcggcattgattcttacggtttaagtagtgtcccgtatggtaaatactggagggagttgagaaaggtgtgtgttcacaacctgctgagtaatcagcaattgctgaagttcagacatcttataatctcccaagtggatacgtcttttaacaagttgtatgagctgtgtaagaactctgaagataatcaaggtatggtaaggatggatgattggctagctcaactttcctttaacgtcatcggtaggatcgtttgcggattccagtctgacccaaagacgggtgcaccttcaagggtagaacagtttaaggaagtcataaatgaggcgtcatattttatgtcaacaagtccagtctccgataacgtaccaatgttgggatggatcgaccaattgaccggtctgacgaggaacatgaagcattgtgggaagaagcttgacttagtagtggagtcaattatcaaggaccataggcaaaagagacgtttttcacgtacaaaaggtggcgatgagaaggatgacgaacaggacgactttattgatatttgcttgagcatcatggagcagccacagttgcccgggaacaattctccccctcaaattccgatcaaatctatcgtgctagacatgattgggggtggtaccgacactacgaaacttacaaccatatggaccctatcacttttgttgaacaatcctcacgtgttagataaagctaaacaagaggtcgacgctcactttcgtaaaaagagaagatcaacagatgacgcagcagcggcagtcgttgattttgacgacataagaaatttagtatacatccaagccatcattaaagaaagtatgaggctttatccagccagcccggtggttgagcgtctttccggcgaggattgcgttgttggaggttttcacgtgcctgctggtacgagactatgggctaacgtttggaagatgcaaagagatcccaaagtttgggacgatcctctagtattcagacctgaaaggtttttgagcgacgagcaaaagatggtagacgttcgtggccaaaactatgaacttctgccattcggcgcaggaagaagaatctgtccaggcgtttcctttagtcttgaccttatgcaacttgtcctaaccaggttaatcctagagttcgaaatgaagtccccgtccggcaaggtagatatgaccgcaactccaggactaatgtcttacaaggtggttccattggacatattgctgactcaccgtcgtatcaagtcatgcgttcaattggcgtcttctgaacgtgattaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtacatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaaatggaaagttctggggtgcctgtgatcacattgtcctcaggtaaagtaatgcccgtactgggcatgggaaccttcgaaaaggtgggtaaggggtctgaacgtgagcgtttagccattcttaaagcgatcgaagttggttaccgttactttgataccgcagcggcatatgaaacggaagaagttctaggggaagccattgctgaagctttacaattgggtctgatagagagccgtgacgagctgttcatcagctcaatgctttggtgcaccgacgcacatccagaccgtgtgctacttgctctgcaaaacagtctgagaaatctaaaacttgaatatctagacctatatatgttgccgtttcctgccagccttaagccgggcaaaattacgatggatattcctgaggaggatatttgccgtatggattatcgttcagtctggagcgccatggaagagtgtcaaaacttaggatttactaaaagtattggtgtaagcaacttttcttgcaagaaattacaagaattaatggccactgcaaatatcccgcccgcggtaaatcaagtagagatgtcaccagctttccaacagaaaaaactgagggaatattgtaacgcaaacaacatattggtatccgcagtaagcattctgggatcaaacgggacgccctggggtagtaatgctgttcttggaagcgaagttttgaaacagatcgcgatggcgaaaggcaaaagcgttgcgcaagtcagtatgaggtgggtctatgagcagggcgcgtctttagtagtcaagagtttctctgaagaacgtttaagagaaaacctgaatatttttgactgggagcttacgaaagaagacaatgagaagataggcgaaatcccgcaatgtagaatccttactgcgtacttccttgtctccccgaacggcccgtttaaatctcaggaagagctttgggatgacaaggcataaacaggccccttttcctttgtcgatatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgtaatcattatcactttacgggtcctttccggtgatccgacaggttacggggcggcgacctcgcgggttttcgctatttatgaaaattttccggtttaaggcgtttccgttcttcttcgtcataacttaatgtttttatttaaaatacctcgcgagtggcaacactgaaaatacccatggagcggcgtaaccgtcgcacaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcagtggaacgtgcattatgaattagttacgctagggataacagggtaatatagaacccgaacgaccgagcgcagcggcggccgcgctgataccgccgc

SEQ ID NO: 28 - DNA, 8456 bp, Artificial Sequence
  Description of Artificial Sequence: Synthetic polynucleotide
cctcgccgcagttaattaaagtcagtgagcgaggaagcgcgtaactataacggtcctaaggtagcgaatcctgatgcggtattttctccttacgcatctgtgcggtatttcacaccgcatagatcggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctttcggggctctcttgccttccaacccagtcagaaatcgagttccaatccaaaagttcacctgtcccacctgcttctgaatcaaacaagggaataaacgaatgaggtttctgtgaagctgcactgagtagtatgttgcagtcttttggaaatacgagtcttttaataactggcaaaccgaggaactcttggtattcttgccacgactcatctccatgcagttggacgatatcaatgccgtaatcattgaccagagccaaaacatcctccttaagttgattacgaaacacgccaaccaagtatttcggagtgcctgaactatttttatatgcttttacaagacttgaaattttccttgcaataaccgggtcaattgttctctttctattgggcacacatataatacccagcaagtcagcatcggaatctagagcacattctgcggcctctgtgctctgcaagccgcaaactttcaccaatggaccagaactacctgtgaaattaataacagacatactccaagctgcctttgtgtgcttaatcacgtatactcacgtgctcaatagtcaccaatgccctccctcttggccctctccttttcttttttcgaccgaattaattcttaatcggcaaaaaaagaaaagctccggatcaagattgtacgtaaggtgacaagctatttttcaataaagaatatcttccactactgccatctggcgtcataactgcaaagtacacatatattacgatgctgttctattaaatgcttcctatattatatatatagtaatgtcgtgatctatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaaggtgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggacgcgtagtctagaccagccaggacagaaatgcctcgacttcgctgctacccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacattatgagggaagcggtgatcgccgaagtatcgactcaactatcagaggtagttggcgccatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccggctgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagcattcaaggcgccttgattatttgacgtggtttgatggcctccacgcacgttgtgatatgtagatgagagcgttggttggtggatcaagcccacgcgtaggcaatcctcgagcagatccgccaggcgtgtatatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggacctttgcagcataaattactatacttctatagacacacaaacacaaatacacacactaaattaataatggaacttcagtacttctcctattttcaacccacttcatctgtcgtagccctactactagcactagtgagtattttatttagcgtagttgttttgaggaagactttcagtaacaattactccagccccgcgtcaagtacggaaaccgctgtgctgtgtcatcagaggcaacagagttgcgccctacctatcagcggccttcttcacgtgttcatgaataagaacggcctgattcatgtcaccttgggaaatatggctgacaaatatggccctatcttcagttttccgacaggcagccaccgtactttagtagtcagttcctgggaaatggtgaaagagtgtttcaccggtaataacgacacggcattctccaacagaccaatccctttggcttttcaaaccatattctacgcctgtggcggcattgattcttacggtttaagtagtgtcccgtatggtaaatactggagggagttgagaaaggtgtgtgttcacaacctgctgagtaatcagcaattgctgaagttcagacatcttataatctcccaagtggatacgtcttttaacaagttgtatgagctgtgtaagaactctgaagataatcaaggtatggtaaggatggatgattggctagctcaactttcctttaacgtcatcggtaggatcgtttgcggattccagtctgacccaaagacgggtgcaccttcaagggtagaacagtttaaggaagtcataaatgaggcgtcatattttatgtcaacaagtccagtctccgataacgtaccaatgttgggatggatcgaccaattgaccggtctgacgaggaacatgaagcattgtgggaagaagcttgacttagtagtggagtcaattatcaaggaccataggcaaaagagacgtttttcacgtacaaaaggtggcgatgagaaggatgacgaacaggacgactttattgatatttgcttgagcatcatggagcagccacagttgcccgggaacaattctccccctcaaattccgatcaaatctatcgtgctagacatgattgggggtggtaccgacactacgaaacttacaaccatatggaccctatcacttttgttgaacaatcctcacgtgttagataaagctaaacaagaggtcgacgctcactttcgtaaaaagagaagatcaacagatgacgcagcagcggcagtcgttgattttgacgacataagaaatttagtatacatccaagccatcattaaagaaagtatgaggctttatccagccagcccggtggttgagcgtctttccggcgaggattgcgttgttggaggttttcacgtgcctgctggtacgagactatgggctaacgtttggaagatgcaaagagatcccaaagtttgggacgatcctctagtattcagacctgaaaggtttttgagcgacgagcaaaagatggtagacgttcgtggccaaaactatgaacttctgccattcggcgcaggaagaagaatctgtccaggcgtttcctttagtcttgaccttatgcaacttgtcctaaccaggttaatcctagagttcgaaatgaagtccccgtccggcaaggtagatatgaccgcaactccaggactaatgtcttacaaggtggttccattggacatattgctgactcaccgtcgtatcaagtcatgcgttcaattggcgtcttctgaacgtgattaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtattcagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaaatggaaagttctggggtgcctgtgatcacattgtcctcaggtaaagtaatgcccgtactgggcatgggaaccttcgaaaaggtgggtaaggggtctgaacgtgagcgtttagccattcttaaagcgatcgaagttggttaccgttactttgataccgcagcggcatatgaaacggaagaagttctaggggaagccattgctgaagctttacaattgggtctgatagagagccgtgacgagctgttcatcagctcaatgctttggtgcaccgacgcacatccagaccgtgtgctacttgctctgcaaaacagtctgagaaatctaaaacttgaatatctagacctatatatgttgccgtttcctgccagccttaagccgggcaaaattacgatggatattcctgaggaggatatttgccgtatggattatcgttcagtctggagcgccatggaagagtgtcaaaacttaggatttactaaaagtattggtgtaagcaacttttcttgcaagaaattacaagaattaatggccactgcaaatatcccgcccgcggtaaatcaagtagagatgtcaccagctttccaacagaaaaaactgagggaatattgtaacgcaaacaacatattggtatccgcagtaagcattctgggatcaaacgggacgccctggggtagtaatgctgttcttggaagcgaagttttgaaacagatcgcgatggcgaaaggcaaaagcgttgcgcaagtcagtatgaggtgggtctatgagcagggcgcgtctttagtagtcaagagtttctctgaagaacgtttaagagaaaacctgaatatttttgactgggagcttacgaaagaagacaatgagaagataggcgaaatcccgcaatgtagaatccttactgcgtacttccttgtctccccgaacggcccgtttaaatctcaggaagagctttgggatgacaaggcataaacaggccccttttcctttgtcgatatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgtaatcattatcactttacgggtcctttccggtgatccgacaggttacggggcggcgacctcgcgggttttcgctatttatgaaaattttccggtttaaggcgtttccgttcttcttcgtcataacttaatgtttttatttaaaatacctcgcgagtggcaacactgaaaatacccatggagcggcgtaaccgtcgcacaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcagtggaacgtgcattatgaattagttacgctagggataacagggtaatatagaacccgaacgaccgagcgcagcggcggccgcgctgataccgccgc

SEQ ID NO: 29 - DNA, 8456 bp, Artificial Sequence
  Description of Artificial Sequence: Synthetic polynucleotide
cctcgccgcagttaattaaagtcagtgagcgaggaagcgcgtaactataacggtcctaaggtagcgaatcctgatgcggtattttctccttacgcatctgtgcggtatttcacaccgcatagatcggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctttcggggctctcttgccttccaacccagtcagaaatcgagttccaatccaaaagttcacctgtcccacctgcttctgaatcaaacaagggaataaacgaatgaggtttctgtgaagctgcactgagtagtatgttgcagtcttttggaaatacgagtcttttaataactggcaaaccgaggaactcttggtattcttgccacgactcatctccatgcagttggacgatatcaatgccgtaatcattgaccagagccaaaacatcctccttaagttgattacgaaacacgccaaccaagtatttcggagtgcctgaactatttttatatgcttttacaagacttgaaattttccttgcaataaccgggtcaattgttctctttctattgggcacacatataatacccagcaagtcagcatcggaatctagagcacattctgcggcctctgtgctctgcaagccgcaaactttcaccaatggaccagaactacctgtgaaattaataacagacatactccaagctgcctttgtgtgcttaatcacgtatactcacgtgctcaatagtcaccaatgccctccctcttggccctctccttttcttttttcgaccgaattaattcttaatcggcaaaaaaagaaaagctccggatcaagattgtacgtaaggtgacaagctatttttcaataaagaatatcttccactactgccatctggcgtcataactgcaaagtacacatatattacgatgctgttctattaaatgcttcctatattatatatatagtaatgtcgtgatctatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaaggtgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggacgcgtagtctagaccagccaggacagaaatgcctcgacttcgctgctacccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacattatgagggaagcggtgatcgccgaagtatcgactcaactatcagaggtagttggcgccatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccggctgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagcattcaaggcgccttgattatttgacgtggtttgatggcctccacgcacgttgtgatatgtagatgattcagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaaatggaacttcagtacttctcctattttcaacccacttcatctgtcgtagccctactactagcactagtgagtattttatttagcgtagttgttttgaggaagactttcagtaacaattactccagccccgcgtcaagtacggaaaccgctgtgctgtgtcatcagaggcaacagagttgcgccctacctatcagcggccttcttcacgtgttcatgaataagaacggcctgattcatgtcaccttgggaaatatggctgacaaatatggccctatcttcagttttccgacaggcagccaccgtactttagtagtcagttcctgggaaatggtgaaagagtgtttcaccggtaataacgacacggcattctccaacagaccaatccctttggcttttcaaaccatattctacgcctgtggcggcattgattcttacggtttaagtagtgtcccgtatggtaaatactggagggagttgagaaaggtgtgtgttcacaacctgctgagtaatcagcaattgctgaagttcagacatcttataatctcccaagtggatacgtcttttaacaagttgtatgagctgtgtaagaactctgaagataatcaaggtatggtaaggatggatgattggctagctcaactttcctttaacgtcatcggtaggatcgtttgcggattccagtctgacccaaagacgggtgcaccttcaagggtagaacagtttaaggaagtcataaatgaggcgtcatattttatgtcaacaagtccagtctccgataacgtaccaatgttgggatggatcgaccaattgaccggtctgacgaggaacatgaagcattgtgggaagaagcttgacttagtagtggagtcaattatcaaggaccataggcaaaagagacgtttttcacgtacaaaaggtggcgatgagaaggatgacgaacaggacgactttattgatatttgcttgagcatcatggagcagccacagttgcccgggaacaattctccccctcaaattccgatcaaatctatcgtgctagacatgattgggggtggtaccgacactacgaaacttacaaccatatggaccctatcacttttgttgaacaatcctcacgtgttagataaagctaaacaagaggtcgacgctcactttcgtaaaaagagaagatcaacagatgacgcagcagcggcagtcgttgattttgacgacataagaaatttagtatacatccaagccatcattaaagaaagtatgaggctttatccagccagcccggtggttgagcgtctttccggcgaggattgcgttgttggaggttttcacgtgcctgctggtacgagactatgggctaacgtttggaagatgcaaagagatcccaaagtttgggacgatcctctagtattcagacctgaaaggtttttgagcgacgagcaaaagatggtagacgttcgtggccaaaactatgaacttctgccattcggcgcaggaagaagaatctgtccaggcgtttcctttagtcttgaccttatgcaacttgtcctaaccaggttaatcctagagttcgaaatgaagtccccgtccggcaaggtagatatgaccgcaactccaggactaatgtcttacaaggtggttccattggacatattgctgactcaccgtcgtatcaagtcatgcgttcaattggcgtcttctgaacgtgattaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtagagcgttggttggtggatcaagcccacgcgtaggcaatcctcgagcagatccgccaggcgtgtatatatagcgtggatggccaggcaactttagtgctgacacatacaggcatatatatatgtgtgcgacaacacatgatcatatggcatgcatgtgctctgtatgtatataaaactcttgttttcttcttttctctaaatattctttccttatacattaggacctttgcagcataaattactatacttctatagacacacaaacacaaatacacacactaaattaataatggaaagttctggggtgcctgtgatcacattgtcctcaggtaaagtaatgcccgtactgggcatgggaaccttcgaaaaggtgggtaaggggtctgaacgtgagcgtttagccattcttaaagcgatcgaagttggttaccgttactttgataccgcagcggcatatgaaacggaagaagttctaggggaagccattgctgaagctttacaattgggtctgatagagagccgtgacgagctgttcatcagctcaatgctttggtgcaccgacgcacatccagaccgtgtgctacttgctctgcaaaacagtctgagaaatctaaaacttgaatatctagacctatatatgttgccgtttcctgccagccttaagccgggcaaaattacgatggatattcctgaggaggatatttgccgtatggattatcgttcagtctggagcgccatggaagagtgtcaaaacttaggatttactaaaagtattggtgtaagcaacttttcttgcaagaaattacaagaattaatggccactgcaaatatcccgcccgcggtaaatcaagtagagatgtcaccagctttccaacagaaaaaactgagggaatattgtaacgcaaacaacatattggtatccgcagtaagcattctgggatcaaacgggacgccctggggtagtaatgctgttcttggaagcgaagttttgaaacagatcgcgatggcgaaaggcaaaagcgttgcgcaagtcagtatgaggtgggtctatgagcagggcgcgtctttagtagtcaagagtttctctgaagaacgtttaagagaaaacctgaatatttttgactgggagcttacgaaagaagacaatgagaagataggcgaaatcccgcaatgtagaatccttactgcgtacttccttgtctccccgaacggcccgtttaaatctcaggaagagctttgggatgacaaggcataaacaggccccttttcctttgtcgatatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgtaatcattatcactttacgggtcctttccggtgatccgacaggttacggggcggcgacctcgcgggttttcgctatttatgaaaattttccggtttaaggcgtttccgttcttcttcgtcataacttaatgtttttatttaaaatacctcgcgagtggcaacactgaaaatacccatggagcggcgtaaccgtcgcacaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcagtggaacgtgcattatgaattagttacgctagggataacagggtaatatagaacccgaacgaccgagcgcagcggcggccgcgctgataccgccgc

SEQ ID NO: 30 - protein, 153 aa, Papaver bracteatum
MAPRGVSGLVGKLSTELDVNCDAEKYYNMYKNGEDVQKAVPHLCMDVKVISGDATRSGCIKEWNVNIDGKTIRSVEETTHNDETKTLRHRVFEGDMMKDYKKFDTIMEVNPKPDGNGCVVTRSIEYEKVNENSPTPFDYLQFGHQAMEDMNKY

SEQ ID NO: 31 - protein, 144 aa, Papaver setigerum
MLVGKLSTELEVDCDAEKYYNMYKHGEDVKKALCVDVKVISGDPTRSGCIKEWNVNIDGKTIRSVEETTHNDETKTLRHRVFEGDMMKDFKKFDTIMVVNPKPDGNGCVVTRSIEYEKTNENSPTPFDYLQFGHQAIEDMNKYL

SEQ ID NO: 32 - protein, 141 aa, Papaver setigerum
MLVGKLSTELEVDCDAEKYYNMYKHGEDKRQCVDVKVISGDPTRSGCIKEWNVNIDGKTIRSVEETTHNDETKTLRHRVFEGDMMKDFKKFDTIMVVNPKPDGNGCVVTRSIEYEKTNENSPTPFDYLQFGHQAIEDMNKY

SEQ ID NO: 33 - protein, 147 aa, Papaver setigerum
MLVGKLSTELEVDCDAEKYYNMYKHGEDVKKAVPHLCVDVKIISGDPTSSGCIKEWNVNIDGKTIRSVEETTHDDETKTLRHRVFEGDVMKDFKKFDTIMVVNPKPDGNGCVVTRSIEYEKTNENSPTPFDYLQFGHQAIEDMNKYL

SEQ ID NO: 34 - protein, 109 aa, Papaver setigerum
MVKIISGDPTSSGCIKEWNVNIDGKTIRSVEETTHDDETKTLRHRVFEGDVMKDFKKFDTIMVVNPKPDGNGCVVTRSIEYEKTNENSPTPFDYLQFGHQAIEDMNKYL

SEQ ID NO: 35 - protein, 180 aa, Papaver somniferum
MDSINSSIYFCAYFRELIIKLLMAPPGVSGLVGKLSTELEVNCDAEKYYNMYKHGEDVQKAVPHLCVDVKVISGDPTRSGCIKEWNVNIDGKTIRSVEETTHNDETKTLRHRVFEGDVMKDFKKFDTIMVVNPKPDGNGCVVTRSIEYEKTNDNSPTPFDYLQFGHQAIEDMNKYLRDSE

SEQ ID NO: 36 - protein, 164 aa, Papaver somniferum
MNFFIKDHLYICLVGKLSTELEVDCDAEKYYNMYKHGEDVKKAVPHLCVDVKIISGDPTSSGCIKEWNVNIDGKTIRSVEETTHDDETKTLRHRVFEGDVMKDFKKFDTIMVVNPKPDGNGCVVTRSIEYEKTNENSPTPFDYLQFGHQAIEDMNKYLRDSESN

SEQ ID NO: 37 - protein, 160 aa, Papaver somniferum
MAPLGVSGLVGKLSTELEVDCDAEKYYNMYKHGEDVKKAVPHLCVDVKIISGDPTSSGCIKEWNVNIDGKTIRSVEETTHDDETKTLRHRVFEGDVMKDFKKFDTIMVVNPKPDGNGCVVTRSIEYEKTNENSPTPFDYLQFGHQAIEDMNKYLRDSESN

SEQ ID NO: 38 - protein, 400 aa, Papaver somniferum
MMKVCVSSREKIKPSRPTPGHLKTHKLSFLDQVAARIYVPLLLYYAGNKENVDTDTRCNIIKKSLAETLTKFYILAGKIVNDEIERFVNCNDDGVDFCVTKVSNCQLFQVIKRPDIFDQVTLFLPFDPCDNEITASGDFLLSVQVNVFEDCRGMVIGLCINHKVADASSITTFVNYWATIARGLVLNVDDRQIQDPCFQVQSIFPQKEKGIGFKISSSSIDGTLVTKKFGFEASKLAELKERCKFAGATEDIRGGYKPNRVEALSTFLWKCFIDIDQAKTKAAAPARVYLASNAVNIRSRIVPQLPTSSFGNMVAITDAIFTVNSNENNGINDPYYPKLVQKFRDAVKRVDGEYIEALQSTDLLLNNVTKLFKHILNGQTLSISFTSWCRFPFYDTDLLD

SEQ ID NO: 39 - protein, 386 aa, Papaver somniferum
MKVQVISKELIKPSTPTPPRLRNFKLSLLDQLLPPFYVPIIIFYPANDDHESNNNDQCIKANILKKSLSETLTRFYPIAGRIRDKILVECNDEGVHYIEAKVNAVMSDFMSLDVIHQLHPSYITLDDLAEEAQLAVQVTMFDCGGIALSICSSHKIIDGCTSTTFLNSWAATARAPSNPEIVYPTFDAAAIFPAQPSGVQVSTLESDDRLQGENVVTKRFLFSASKITALRARIAESRSSNILSKYPSRSEAVSALVWKSFMETSRVKVTREHTFSAEASTKPIVRSIANFVVNLRTRLNPPLPNVSFGNIIMDATAESLIIDNGENTLGFVETLDGLISQLRLGVTKMDDEYVRKLREDDVEFLKSLDEASHPSNGEGDGNGERV

SEQ ID NO: 40 - protein, 525 aa, Papaver setigerum
MNDTMKIEVVSKESIKPSYPTPNNLKIHNLSNLDQLIPAFYMDHILYYPSLDSNDSSLGDDEEDKKMIFSASSRHRCDVVKKSLAETLTRYYPLAGRIKDEKSVECNDEGVDYIEARVVGITVSQVIQLASSDIEVMEPFLPYEPYGGTGSAFRRAGIHSNSKPLLKIQVNVFDCGGMVICLSGSHKVIDATSILNFVNDWAATARGGFDTHDDELKVAVVDKPCYIFSSMFPPTSFGNQEEKDTADQAQLVPDRIEIVTKRFVFKDSSIAKLKKKCIHVNTNNGSDHQVDKQEHNMQQMPSRIEALTSLIWMCFMDVDRRFRVKQIDDAVSPVNTVNEVSLPKQVQYVAGFAINLRTRTIQPLPTNSFGNMTDTAIAEVTLNLTGSDHFNNEKGIRDQSQNYPELVSKIKDSIKLVDNKHIEAMKRNLAISCNNIKMHQMMKESTFDQNTRELLMFSSWCRFPIYEADFGWGKPSWASITKLLYKNCVMFLDTSSGDGIEAWVSLKEEDMVEFERHEELVALAS

SEQ ID NO: 41 - protein, 459 aa, Papaver somniferum
MKVQVISKEIIKPSSPTPPHLRNFKLSLLDQILPPFYVPIVMFYPAGDDYVTNNNIHDQSSKSEFLKKSLSETLTRFYPIAGRIKDNILIDCNNEGVDYIEAKVNGIMSDFMSVDVVHQLHPSHIMLDDVAKEAQLAVQVNLFDCGGIAISISMSHKIVDACTAITFINGWAATARAAPKQEIVCPTFDSAAIFPALPPGVQVSSLESDDSVQGVNVVTKMFAFTAPKIASLRARIAELRSSSDGLSKYPTRTEALSALVWKSFIRTSRVKAARKYSLSPASTKPVIKSVANYAVNLRTRLNPPLPQVSFGNILMDATAESTTTIDDDDSHEFADTLAGLIGQLRLGVSRINGDYIRKLQEGDLAFLKSLDEASHDSNGEKVQICWISSLCRFPFYEADFGWGKPSWVALNTNAEYKNSLFLMDTKCGTGIEAWVSLEEDDMAIFEEDQDLLQCVKSIN

SEQ ID NO: 42 - protein, 477 aa, Papaver setigerum
MENMKVEVVLKQTIKPSTQTPLHSKTFNLSFLDQHLGPPIYIPFTLYYESGDVNNKNNHCDGYKNNLEEACEHRVSVIKQSLSETLARYYPLAGRMKEDNLAVECNDEGVEYFETRVSDVRLSQVIKRSPNHNSVLRKFLPPCISSCDNSMSIPFDYGFKSKTLLAIQVNIFECGGIVIGMCMAHRLADASTMFTFITDWAATARGAIEDIKGPSFDFSYTLFPQKDVINNFKPFDPMLTREEDLVTKYFVFPASKIVELKRRNVNNIVCQDTSQQNTSPCTRVEAVTSFMWKRYMDSVRAKNQTQATSVEKYGALYTVNLRSRITPPLPANSFGNIYTFTIALSTPSDENDIDDGLRKDVSSPNDLNLVGKVRDAIKKIDDKYTRKLQSSEDELVNDVKPLTSGEAIFLGFSSWCRFPIYEADFGWGKPTWVSIGTMALRNTVFLMDTKSGDGIEAFVNMAKEDMDNFEVKLLADQ

SEQ ID NO: 43 - protein, 485 aa, Papaver setigerum
MENMKVEVVLEQTIKPSTQTPLHSKTFNLSFLDQHLGPPIYIPFTLYYESGDVNNKNNHCDGYKNNLEEVCEHRVSVIKQSLSETLARYYPLAGRMKEDNLAVECNDEGVEYFETRVSDVRLSQVIKRSPNHNSVLRKFLPPCISSCDNSMSIPFDYGFKSKTLLAIQVNIFECGGIVIGMCMAHRLADASTMFTFITDWAATARGAIEDIKGPSFDFSYTLFPQKDVINNFKPFDPMLTREEDLVTKYFVFPASKIVELKRRNVNNIVCQDTSQQNTSPCTRVEAVTSFMWKRYMDSVRAKNQTQATSVEKYGALYTVNLRSRITPPLPANSFGNIYTFTIALSTPSDENDIDDGLRKDVSSPNDLNLVGKVRDAIKKIDDKYTRKLQSSEDELVNDVKPLTSGEAIFLGFSSWCRFPIYEADFGWGKPTWVSIGTMALRNTVFLMDTKSGDGIEAFVNMAKEDMDNFEVKLLADQLLHVHPTV

SEQ ID NO: 44 - protein, 452 aa, Papaver setigerum
MSSTVEVISKQTIKPSTPTPIQRKNHSLSLIDQHFAPIYIPIVLFYPAAAVNDTGNVQHGDNTCVLKRSLSETLVHFYPLAGRMKDNIVVDCNDQGVEFTEVKVSGTMCDFLMKPDEQLSGLLPSEAVCMNFVREAQVMIQVNTFDCGSKAISLCVSHKIADASTITTFSRCWAETTIAVSKSTSAVTPIVSSKFHPTFDAASLFPPIKQLISPSGVTPALPELIPSEESKFGKIISKRFLFSATTINSVREKLSALMADKLKYRRLTRVEVVSALIWNSFDKLATTGSVAVMVKHAVNLRKRIDPPLPDVSFGNILEFTKAVVGEAAANTTTQGTVGSSSKLLEELSEFAGQLREPVSKMNKGDHDFDMENTDYEERDLWMSSWCNYGLYDIDFGCGKPVWVTTVATMYPYSDGFFMNDTRCGQGIEVWGNLVEEDMANFQLNLSELLDRI

SEQ ID NO: 45 - protein, 451 aa, Papaver somniferum
MMKVCVSSREKIKPSRPTPGHLKTHKLSFLDQVAARIYVPLLLYYAGNKENVDTDTRCNIIKKSLAETLTKFYILAGKIVNDEIERFVNCNDDGVDFCVTKVSNCQLFQVIKRPDIFDQVTLFLPFDPCDNEITASGDFLLSVQVNVFEDCRGMVIGLCINHKVADASSITTFVNYWATIARGLVLNVDDRQIQDPCFQVQSIFPQKEKGIGFKISSSSIDGTLVTKKFGFEASKLAELKERCKFTTEPEDGYKPTRVEALSAFLWKCFIDIDQAKLKGVARTKVYLATNAVNMRSRMVPQLPTSSFGNIISITDAVFSINNDDSTGINDPYYPKLVRKFRDAIKKIDRDYIEALRSTDLLLNNMMKLIEHVLSGHTLSIYFSSWCRFPLYETDFGWGKPIWVSTCTIPQKNVIVLMDSNSSADGIEAYVTLAKEDMGELEHHEELLALIS

SEQ ID NO: 46 - protein, 232 aa, Papaver somniferum
MGAMKFFSFLAVAMVLSLAHIQAQQGNWGDETVPYTMGPEKITKLRFYFHDIVTGNNPTAVQIAQATGTNSSSTLFGALFMIDDPLTEGPDPDSRLVGRAQGFYGSAGQNEAALILGMSLVFTGNEKFNGSTISVLSRNPVTHTEREFAIVGGTGYFQFARGFISAKTYSLVGPNAVVEYNCTIVHPSSVSESGKSNSSPGKSDSNSGSQISLGSNLVFVSVIAYVTIILSL

SEQ ID NO: 47 - protein, 224 aa, Papaver setigerum
MVLSMSHSQAQEGNWGDESVPYTMGPEKMTKLRFYFHDIITGNSPTAVQIAQATGTNTSATMFGALMMIDDPLTEGPDPNSRLVGRAQGFYGSAGQNELALILGMSLVFTGNEKFNGSTISVLSRNPVMHTEREFAIVGGTGYFQFARGFISAKTYSLVGPNAVVEYNCTIVHPSSVSESGKSDSSSGKSDSSSGSQISLGTNLVFLSVIAFVTIIVSPQHFSW

SEQ ID NO: 48 - protein, 210 aa, Papaver somniferum
MTKTVLVDDIPFPQNITTVTTEKQLPLLGQGITDMEIHFLQIKFTAIGTAIGVYLEPEIASHLQQWKGKTGAELSQDDEFFAAVVSASVEKYVRVVVIKEIKGSQYMLQLESWVRDELAAADKYEDEEEESLDKVIEFFQSKYLKQLSFIPSHFSATTPAVAEIGLEIEGQKDLKIKVENGNVIEMIQKWYLGGTRGVSPSTTQSLATSL

SEQ ID NO: 49 - protein, 210 aa, Papaver somniferum
MPFLKAIEIEGCKFRPFVTPPGSTQILFLAGSGVKEEFGDSKSMKYSSCAIYLQPTCILYLAKAWAQKSVVDITQSLNFFMDIATGPFEKYCRITMLETAKGEDYAAMITKNCEEMLTNSKRYSETAKAALTKFSEAFNGRTLASGSSIHVTVSTSNSVTLAFTEDGSTPKQGDVTLDCKEVGEAFLMSTISLHTTIRESMGSRISGLYK

SEQ ID NO: 50 - protein, 166 aa, Papaver setigerum
MAPMAQLSEIQVEQFVFPPTMTPPSSTESLFLGGAGVRGLQIQDRFIKFTAIGVYLAEEAIPSLSPKWKSKSPEELTDDVEFFMDIVTGPFEKFVKITMILPLTGDQYAEKVTENCIQYLKSKDMYTDAEAKAVERFIEIFKNEMFPPASSILFTISPAGSLTVGF

SEQ ID NO: 51 - protein, 160 aa, Papaver rhoeas
MVYLEPEIATHLKQWKGKTGAELSQDDDFFSAVVSAPVEKYVRVVVIKEIKGSQYMLQLESWVRDELAAADKYEDEEEESLDKVIEFFQSKYLKQHSVIITFHFSATTPAVAEIGLEIEGQKDLKIKVENGNVVEMIQKWYLGGTRGVSPSTTQSLATSL

SEQ ID NO: 52 - protein, 206 aa, Papaver bracteatum
MTKMVLVDDIPFPQNITTATTAKQLPLLGQGITDMEIHFLQIKFTAIGVYLEPEIASHLKQWKGKTGAELSQDDEFFSAIVSAPVEKYVRVVVIKEIKGSQYMLQLESWVRDELAAADKYEDEEEESLEKVIEFFQSKYLKQHSVIPFHFSATTPAVAEIGLEIEGHKDLKMKVENGNVVEMIQKWYLAGTRGVSPSTTQSLATSL

SEQ ID NO: 53 - protein, 216 aa, Papaver bracteatum
MAPMAQLSEIQVEQFVFPPTMTPPSSTESLFLGGAGVRGLQIQDRFIKFTAIGVYLAEEAIPSLSPKWKSKTPEELTNDVEFFMDIVTGPFEKFVKITMILPLTGDQYAEKVTENCVEYLKSKDLYTDAEAKAVERFIEIFKNEMFPPASSILFTISPTGSLTVGFSKDTSIPEARNAVIENKALSESILESIIGKNGVSPAAKQSLAERISELLK

SEQ ID NO: 54 - protein, 151 aa, Panax ginseng
MGLTGKLICQTGIKSDGDVFHELFGTRPHHVPNITPANIQGCDLHEGEFGKVGSVVIWNYSIDGNAMIAKEEIVAIDEEDKSVTFKVVEGHLFEEFKSIVFSVHVDTKGEDNLVTWSIDYEKLNESVKDPTSYLDFLLSVTRDIEAHHLPK

SEQ ID NO: 55 - protein, 157 aa, Arachis hypogaea
MGVFTFEDEITSTVPPAKLYNAMKDADSITPKIIDDVKSVEIVEGNGGPGTIKKLTIVEDGETKFILHKVESIDEANYAYNYSVVGGVALPPTAEKITFETKLVEGPNGGSIGKLTLKYHTKGDAKPDEEELKKGKAKGEGLFRAIEGYVLANPTQY

SEQ ID NO: 56 - protein, 166 aa, Hypericum perforatum
MGIDPFTMAAYTIVKEEESPIAPHRLFKALVLERHQVLVKAQPHVFKSGEIIEGDGGVGTVTKITFVDGHPLTYMLHKFDEIDAANFYCKYTLFEGDVLRDNIEKVVYEVKLEAVGGGSKGKITVTYHPKPGCTVNEEEVKIGEKKAYEFYKQVEEYLAANPEVFA

SEQ ID NO: 57 - protein, 158 aa, Lupinus luteus
MGVFTFQDEYTSTIAPAKLYKALVTDADIIIPKAVETIQSVEIVEGNGGPGTIKKLTFIEGGESKYVLHKIEAIDEANLGYNYSIVGGVGLPDTIEKISFETKLVEGANGGSIGKVTIKIETKGDAQPNEEEGKAAKARGDAFFKAIESYLSAHPDYN

SEQ ID NO: 58 - protein, 161 aa, Fragaria x ananassa
MAGVFTYETEFTSVIPPPRLFKAFILDADNLIPKIAPQAVKCAEIIEGDGGVGTIKKITFGEGSQFGSVTHKIDGIDKENFVYSYSLIEGDALSDKIEKISYETKLVSSSDGGSIIKSTSNYHTKGDVEIKEEHVKAGKEKFSHLFKLVEGYLLANPNEYC

SEQ ID NO: 59 - protein, 150 aa, Actinidia deliciosa
MDLSGKMVKQVEILSDGIVFYEIFRYRLYLISEMSPVNIQGVDLLEGNWGTVGSVIFFKYTIDGKEKTAKDIVEAIDEETKSVTFKIVEGDLMELYKTFIIIVQVDTKGEHNSVTWTFHYEKLKEDVEEPNTLMNFCIEITKDIETYHLK

SEQ ID NO: 60 - protein, 164 aa, Thalictrum flavum
MGIINQVSTVTKVIHHELEVAASADDIWTVYSWPGLAKHLPDLLPGAFEKLEIIGDGGVGTILDMTFVPGEFPHEYKEKFILVDNEHRLKKVQMIEGGYLDLGVTYYMDTIHVVPTGKDSCVIKSSTEYHVKPEFVKIVEPLITTGPLAAMADAISKLVLEHKS

SEQ ID NO: 61 - protein, 155 aa, Vigna radiata
MVKEFNTQTELSVRLEALWAVLSKDFITVVPKVLPHIVKDVQLIEGDGGVGTILIFNFLPEVSPSYQREEITEFDESSHEIGLQVIEGGYLSQGLSYYKTTFKLSEIEEDKTLVNVKISYDHDSDIEEKVTPTKTSQSTLMYLRRLERYLSNGSA

SEQ ID NO: 62 - protein, 364 aa, Papaver sp.
MEKAKLMKLGNGMEIPSVQELAKLTLAEIPSRYVCANENLLLPMGASVINDHETIPVIDIENLLSPEPIIGKLELDRLHFACKEWGFFQVVNHGVDASLVDSVKSEIQGFFNLSMDEKTKYEQEDGDVEGFGQGFIESEDQTLDWADIFMMFTLPLHLRKPHLFSKLPVPLRETIESYSSEMKKLSMVLFNKMEKALQVQAAEIKGMSEVFIDGTQAMRMNYYPPCPQPNLAIGLTSHSDFGGLTILLQINEVEGLQIKREGTWISVKPLPNAFVVNVGDILEIMTNGIYHSVDHRAVVNSTNERLSIATFHDPSLESVIGPISSLITPETPALFKSGSTYGDLVEECKTRKLDGKSFLDSMRI

SEQ ID NO: 63 - protein, 360 aa, Papaver sp.
METPILIKLGNGLSIPSVQELAKLTLAEIPSRYTCTGESPLNNIGASVTDDETVPVIDLQNLLSPEPVVGKLELDKLHSACKEWGFFQLVNHGVDALLMDNIKSEIKGFFNLPMNEKTKYGQQDGDFEGFGQPYIESEDQRLDWTEVFSMLSLPLHLRKPHLFPELPLPFRETLESYLSKMKKLSTVVFEMLEKSLQLVEIKGMTDLFEDGLQTMRMNYYPPCPRPELVLGLTSHSDFSGLTILLQLNEVEGLQIRKEERWISIKPLPDAFIVNVGDILEIMTNGIYRSVEHRAVVNSTKERLSIATFHDSKLESEIGPISSLVTPETPALFKRGRYEDILKENLSRKLDGKSFLDYMRM

SEQ ID NO: 64 - protein, 364 aa, Papaver somniferum
MEKAKLMKLGNGLSIPSVQELAELTFAEVPSRYVCTNDENLLLMTMGASEIDDETVPVIDLQNLLSPEPAIGKSELDWLHYSCKEWGFFQLVNHGVDALLVDHVKSEIHSFFNLPLNEKTKYGQRDGDVEGFGQAFLVSENQKLDWADMFFINTLPLHLRKPHLFPNLPLPLRETIESYSSEMKKLSMVLFEMMGKAIEVIDIKEAITEMFEDGMQSMRMNYYPPCPQPERVIGITPHSDFDGLTILLQLNEVEGLQIRKEDKWISIKPLPDAFIVNVGDIWEIMTNGVHRSVDHRGVINSTKERLSIATFHSPKLELEIGPISSLIRPETPAVFKSAGRFEDLLKEGLSRKLDGKSFLDCMRM

SEQ ID NO: 65 - protein, 294 aa, Papaver somniferum
MEKAKLMKLGNGMEIPSVQELAKLTLAEIPSRYVCANENLLLPMGASVINDHETIPVIDIENLLSPEPIIGKLELDRLHFACKEWGFFQVVNHGVDASLVDSVKSEIQGFFNLSMDEKTKYEQEDGDVEGFGQGFIESEDQTLDWADIFMMFTLPLHLRKPHLFSKLPVPLRETIESYSSEMKKLSMVLFNKMEKALQVQAAEIKGMSEVFIDGTQAMRMNYYPPCPQPNLAIGLTSHSDFGGLTILLQINEVEGLQIKREGTWISVKPLPNAFVVNVGDILEIMTNGIYHSVD

SEQ ID NO: 66 - protein, 364 aa, Papaver somniferum
METAKLMKLGNGMSIPSVQELAKLTLAEIPSRYICTVENLQLPVGASVIDDHETVPVIDIENLISSEPVTEKLELDRLHSACKEWGFFQVVNHGVDTSLVDNVKSDIQGFFNLSMNEKIKYGQKDGDVEGFGQAFVASEDQTLDWADIFMILTLPLHLRKPHLFSKLPLPLRETIESYSSEMKKLSMVLFEKMEKALQVQAVEIKEISEVFKDMTQVMRMNYYPPCPQPELAIGLTPHSDFGGLTILLQLNEVEGLQIKNEGRWISVKPLPNAFVVNVGDVLEIMTNGMYRSVDHRAVVNSTKERLSIATFHDPNLESEIGPISSLITPNTPALFRSGSTYGELVEEFHSRKLDGKSFLDSMRM

SEQ ID NO: 67 - protein, 369 aa, Papaver bracteatum
METPKSIKLGGSLLVPSVQELAQQSFAEVPARYVRDDLEPLTDLSGVSMIDQTIPVIDLQKLQSPVPIIRELESEKLHSACKEWGFFQVVNHGVDILLVEKTKSEIKDFFNLPMDEKKKFWQEEGDIQGFGQAFVQSEDQKLDWADIFLMVTLPRHTRNPRLFPKLPLPLRNTMDSYSSKLSKLASTLIEMMGKALHMETSVLAELFEDGRQTMRINYYPPCPQPKDVIGLTPHSDGGGLTILLQLNEVDGLQIRKEKIWIPIKPLPNAFVVNIGNILEIMTNGIYRSVEHRATIHSTKERLSVAAFHNPKVGVEIGPIVSMITPESPALFRTIEYDDYGKKYFSRKLDGKSSLDFMRIGEGDEENKAT

SEQ ID NO: 68 - protein, 366 aa, Papaver bracteatum
METPKLIKLGGSLLVPSVLELTKQSPAEVPARYIRNDLEPMTDLSSASLTDQTIPVIDLQNLLSPEPELELEKLHSGCKEWGFFQVMNHGVDILLVEKVKSEIQGFFNLPIDEKNKFWQEEGDLEGYGKAFVHSEDEKLDWADMFFILTQPQYMRKPRVFPKLPLRLRETIESYSLELSKLGLTLLDLMGKALQIETGVMSELFEDGRQTMRMNYYPPCPQPEHVIGLTPHSDGGALTILLQLNQVDGLQIRKEEIWVPIKPLPNAFVVNIGDILEIMSNGVYRSVEHRATINSSKERLSVAIFQSPKHGTEIGPILSMITPEAPALFKTIPYEDYLRKFFSRKLGGKSFVDSMRIGESDEDNNTA

SEQ ID NO: 69 - protein, 366 aa, Papaver bracteatum
METQKQENFGASLSVPNVQELAKQSPEQVPDRYIRSDQDSSTNISCPSMTDQIPVIDLQSLLSPDPIIGELELERLHSACKEWGFFQVVNHGVDNLLVEKVKSEIQGFFNLPMDEKKKFWQEEGDFEGFGQAFVFSEDQKLDWGDVFFILTQPQHMRKPRLFPKLPLPFRKTIESYSLETNKLSMTLLELMEKALKIETGVMTELFEGGIQRMRMTYYPPCPQPKHVIGLTPHSDPDALTILLQLNEVDGLQIRKEKIWVPIKPLSNAFVVNIGDILEIMSNGIYRSVEHRATVNSTKERLSVATFHSPRKDTEIGPILITPETPALFRTSGFEDYFRKFFAHKLNGKSFLSSIRIGETDEGNNAT

SEQ ID NO: 70 - protein, 379 aa, Papaver bracteatum
MEAPKLIMLGGSLFVPSVQELAKQSLAEVPVRYVRDDQDTLGNNINITPMSMIDQSIPVIDLEKLLSPEPIVGELELERLHSACKEWGFFQVVNHGVDSLLVEKVKSEIEGFFKLPMDEKTKFWQEEGDIEGFGQVFVHSQDQKLDWGDMFLMQTLPRHTRKPRLFPNLPLPLRQTIESYSSELSKLVLTLVDLMGKALQMESGVLTELFENGIQRMRMNYYPPCPQPEQVIGLTPHSDVGGLTILLQLNEVDGLQIKKDKVWVPIKPLANAFVVNVGDALEIMSNGIYRSVEHRATINSTKERLSIATFHNPRADREIGPIPSMISPETPALFKTTGYEEYFKKFFSRKLEGKSFLDSLRIREGDEHCGRLDVKGPCN

SEQ ID NO: 71 - protein, 365 aa, Papaver bracteatum
MEIPNPIKIGSSLLVPSVQELAKQSFAEVPARYIRNDVDPLITKLSDVSLIDQTVPVIDLQKLLSPEPIVGELELERLHSACKEWGFFQVVNHGVDNLLVEKVKSEIQGFFNLPMEEKKKFWQEEGDFEGFGQMFVQSEEQKLDWGDMFFILTQPQHMRKPRLFSKLPLPLRETIESYSLELIKLGLTIIKLMEKALQIDAGVMAELFEDGIHTMRMNYYPPCPQPEHVIGLTPHSDGGGLTILLQLNEVDGLQIRRENIWVPIKPLPNAFVVNIGDILEILSNGIYRSVEHRSTVNATKERLSVATFQNPKQESVIGPNMITPERPALFRKIVYKDYMKKLFSRKLDGKSFLDSLRIGEGDERP

SEQ ID NO: 72 - protein, 349 aa, Papaver bracteatum
METLKTVKPGGSLFIPNGQELAKQSLEEVYVGNDQDTMLLIGQTIPVIDLQKLLSPEPITGDMELDKLHSACKEWGFFQVVNHGVDILLVEKVKSEVHDFFNIPMDEKKPFWQEEGDLEGFGQVFITSEDQQLDWGDMFFMVTLPKHMRKPRLFLKLPLPLRETIESYSLKLSKLGVTLVELMGKALQMEDRIMSELFDDGRQTMRMNYYPPCPQPEQVIGLTPHSDPGGLTILLELNEVNGLIRKENIWVPIIPLPNAFIVNIGDILEIMSNGIYHSVEHRATINSTKERLSVAMFNSPKVDTEIGPIHSMITPETPALFRTIGYDEYLKIFFSRKLDGKSLLESMKI

SEQ ID NO: 73 - protein, 379 aa, Papaver bracteatum
  MOD_RES (373)..(373): Any amino acid
  MOD_RES (377)..(377): Any amino acid
MEAPKLIMLGGSLFVPSVQELAKQSLAEVPVRYVRDDQDTLGNNINITPMSMIDQSIPVIDLEKLLSPEPIVGELELERLHSACKEWGFFQVVNHGVDSLLVEKVKSEIEGFFELPVDEKKKFWQEEGDIEGFGQIFVHSEDQKLDWADMFYMLTLPPNMRKPRLFPNLPLPLRQTIDSYSSELSKLVLTLVDLMGKALQMESGVLTELFENGIQRMRMNYYPPCPQPEQVIGLTPHSDVGGLTILLQLNEVDGLQIKKDKIWVPIKPLRNAFVVNVGDALEIMSNGIYRSVEHRATINSTKERLSIATFHNPRADREIGPIPSMISPETPALFKTTGYEEYFKKFFSRKLEGKSFLDSLRIGEGDEHCGRLXVKGXCN

SEQ ID NO: 74 - protein, 362 aa, Papaver bracteatum
METPKLMKLGGSLFVPSVQELAKQSLAEVPARYVRDDRDMVGNIINVTPMSMIDQSIPVIDLEKLLSPDLIVGELELERLHSACKEWGFFQVVNHGVDSLLVEKVKSEIEGFFELPMDEKKKFWQEEGDAEGFAQFFVQSEDQKLDYSGDMFFMLNLPQHMRKPRLFLKLPLPLRETIESYSLKLSKLGVTLVELMGKALQMEDRIMSELFDDGRQTMRMNYYPPCPQPEQVIGLTPHSDPGGLTILLELNEVNGLIRKENIWVPIIPLPNAFIVNIGDILEIMSNGIYHSVEHRATINSTKERLSVAMFNSPKVDTEIGPIHSMITPETPALFRTIGYDEYLKIFFSRKLDGKSLLESMKI

SEQ ID NO: 75 - protein, 365 aa, Papaver bracteatum
METPKLRDFGSFLPVPSVQELAKQVLTEIPPRYIRTDLEALNKLSCASNTDQTVPIIDMQCLLSAEPEMELEKLHSACKEWGFFRVVNHGVDNLESVKSEIESFLNLPVNAKNKYGQKQGDDQGFGSRFVLSEEQKLDWGDFFYMVTRPLYLRKPHLFPELPLPLRETIESYSSEVSKLAMALFEMMGKALKIETGVMTEIFEGGMQAMRMNYYPPCPRPDLVIGLNAHSDFGGLTILLQLNEVEGLEIRNKGEWVSVKPLANAFVVNVGDVMEILTNGIYHSVEHRATINSSKERLSVATFHYPKLETGIGPLPCMITPKTPALFGRIERYELLLRKYYARKLNGKSTLDCMRIGNGFEDDNTA

SEQ ID NO: 76 - protein, 370 aa, Papaver bracteatum
MEAPKLIMLGGSLFVPSVQELAKQSLAEVPARYVRDDQDTLGNNINITPMSMIDQSIPVIDLEKLLSPEPIVGELELERLHSACKEWGFFQVVNHGVDSLLVEKVKSEIEGFFELPVDEKKKFWQEEGDIEGFGQIFVHSEDQKLDWADMFYMLTLPPNMRKPRLFPNLPLPLRQTIDSYSSELSKLVLTLVDLMGKALQMESGVLTELFENGIQRMRMNYYPPCPQPEQVIGLTPHSEVGGLTILLQLNEVDGLQIRKEKIWVPIKPLSNAFIVNIGDILEIMSNGIYRSVEHRATVNSTKERLSVATFHSPRKDTEIGPILITPETPALFRTSGFEDYFRKFFAHKLNGKSFLSSIRIGETDEGNNAT

SEQ ID NO: 77 - protein, 313 aa, Papaver bracteatum
MSMIDQSIPVIDLEKLLSPEPIVGELELERLHSACKEWGFFQVVNHGVDSLLVEKVKSEIEGFFELPVDEKKKFWQEEGDIEGFGQIFVHSEDQKLDWADMFYMLTLPPNMRKPRLFPNLPLPLRQTIDSYSSELSKLVLTLVDLMGKALQMESGVLTELFENGIQRMRMNYYPPCPQPEQVIGLTPHSDVGGLTILLQLNEVDGLQIRKEKIWVPIKPLSNAFIVNIGDILEIMSNGIYHSVEHRATINSTKERLSVAMFNSPKVDTEIGPIHSMITPETPALFRTIGYDEYLKIFFSRKLDGKSLLESMKI

SEQ ID NO: 78 - protein, 365 aa, Papaver bracteatum
METPKLVKSSGSSLFLSTSVQELAKQSLPEVPARYIRTNLEPLSNVSGDSQSVPVIDLQKLLSSEPIIGELELDKLHSACKEWGFFQVVNHGVDNLVMEKIKTEIQGFFNLSLDEKQKFWKKEGDAEGFGQNFIESEDQKLDWGDTFGMFTLPIHMRNPRLFPELPLPLRETIESYSLDVRKLALALIGLMEKALKIKTSAMSELFEDGGQAMRMNYYPPCPQPEHVIGLTPHSDAGGLTILLQLNEVDGLQIKKDKIWVPIKPLPNAFVVNIGDILEIMTNGIYRSVEHRATINSSKERLSVAAFHSPKGDTLIGPMVSLITPETPALFRTIGYQDYMKKFMSRKLDGKSLVNSMRIGEGDEDK

SEQ ID NO: 79 - protein, 356 aa, Papaver bracteatum
METPTLMKLGNGLSVPSVQELAKATLAEIPSRYICTDENLLTMGASTTDNETVPVIDLQNLLSPEPVIGMLELDRLHSACKEWGFFQLVNHGVDALLVDNEVQGFFNLPMDEKTKYGQKDGDDEGFGQFFVISEDQKLDWADVFYMSTLPLHSRKPHLFPELPLPLRETMESYSSEMKKLSMVLFDMMGKALQVVEIKGITELFEDGAQQIRMNYYPPCPQPELVFGLTSHSDFDGLTILLQLGEVEGLQIKKEERWISIKPLPDAFIVNVGDILEIMTNGIYRSVDHRAVVNSIKERLTIATFHDPRLEAEIGPISSLITPETPALFKRGVFEDLLKEMFLRKLDGKSFLDCMRM

SEQ ID NO: 80 - protein, 350 aa, Papaver rhoeas
GNGLSVPSVQELAKQTLAEIPSRYICTDENPLITGASVVDDETVPVINLQNLLSPEPVIGKLELDKLHSACKEWGFFQVVNHGVNDSLVDSVKSEIEGFFNLPANEKLKYGQKDGDVEGFGQHFVVSEDQKLDWADVFYMVTLPVRLRKPHLFPELPLPLRDTLDSYSSELNKLSMVLLEMMEKALKLVECKGITDFFEDGFQQMRMNYYPPCPRPELVTGLTSHSDFGGLTILLQLNDVEGLQIKKEERWISIKPLPNAFIVNIGDVLEIMSNGIYRSVDHRAVINSTKVRMSVATFHDPRLEAVIGPISSLITPETPALFKRGVFEDLLKEMFLRKLDGKSFLDCMRI

SEQ ID NO: 81 - protein, 351 aa, Papaver setigerum
LMKLANGMSVPIVQELAKLTVGEIPSRYICTDGNLLTMGASVIDYETVPVIDLQNLQSREPVIEKLELDRLHSACKEWGFFQLLNHGVDASLMDNVRSEIRGFFNLPISDKMKYGQKDGDEEGFGQHFIVSEDQKLDWVDAFMMFTLPLHSRNPRLTPEFPQPLRETVESYSSEMKKLSVLLFELMEKALQVKGITEMFEDGLQSIRMNYYPPCPRPELAIGLTSHSDFDGLTILLQLNEVEGLQIKKEERWISIKPLPNAFIVNVGDVLEVMTNGIYRSVDHRAVVNSTKERLSIATFHDPELESEIGPIASLITPETPALFKRGRFKDLLKENLSTKLDGKSFLDCIRM

SEQ ID NO: 82 - protein, 497 aa, Homo sapiens
MGLEALVPLAVIVAIFLLLVDLMHRRQRWAARYSPGPLPLPGLGNLLHVDFQNTPYCFDQLRRRFGDVFSLQLAWTPVVVLNGLAAVREALVTHGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 83 - protein, 1049 aa, Bacillus megaterium
MTIKEMPQPKTFGELKNLPLLNTDKPVQALMKIADELGEIFKFEAPGRVTRYLSSQRLIKEACDESRFDKNLSQAAKFARDFAGDGLVTSWTHEKNWKKAHNILLPSFSQQAMKGYHAMMVDIAVQLVQKWERLNADEHIEVSEDMTRLTLDTIGLCGFNYRFNSFYRDQPHPFIISMVRAADEVMNKLQRANPDDPAYDENKRQFQEDIKVMNDLVDKIIADRKARGEQSDDLLTQMLNGKDPETGEPLDDGNIRYQIITFLIAGHETTSGLLSFALYFLVKNPHVLQKVAEEAARVLVDPVPSYKQVKQLKYVGMVLNEALRLWPTAPAFSLYAKEDTVLGGEYPLEKGDEVMVLIPQLHRDKTVWGDDVEEFRPERFENPSAIPQHAFKPFGNGQRACIGQQFALHEATLVLGMMLKHFDFEDHTNYELDIKETLTLKPKGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 84 - protein, 503 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKEMVPIIAQYGDVLVRNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVVVMIPSYALHRDPKYWTEPEKFLPERFSKKNKDNIDPYIYTPFGSGPRNCIGMRFALMNMKLALIRVLQNFSFKPCKETQIPLKLSLGGLLQPEKPVVLKVESRDGTVSGA

SEQ ID NO: 85 - protein, 502 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKEMVPIIAQYGDVLVRNLRREAETGKPVTLKDVFGAYSMDVITSTSFGVNIDSLNNPQDPFVENTKKLLRFDFLDPFFLSIIFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVVVMIPSYALHRDPKYWTEPEKFLPERFSKKNKDNIDPYIYTPFGSGPRNCIGMRFALMNMKLALIRVLQNFSFKPCKETQIPLKLSLGGLLQPEKPVVLKVESRDGTVSGA

SEQ ID NO: 86 - protein, 534 aa, Menispermum canadense
MIMMFIDYYSSWLPQTLLLQSILLAVSLVIFINLFLTRRRSYSSKSHTNIIHPPKAAGALPVIGHLYTLFRGLSAGVPLYRQLDAMADRYGPAFIIHLGVYPTLVVTCRELAKECFTTNDQTFATRPSTCAGKYIGYNYAFFGFAPYGPYWREARKIATVELLSNYRLDSLRHVREAEVGRNVDELYALHASSSTNKQNMMKIDMKQWFDQVTLNVILMMVVGKRCVTTGGNEEEVRVVKVLHEFFKHLGTLSVSDVVPYVEWMDLDGNIGRMKSTAKELDCILGRWLEEHRRERRSDFMDAMLAMVEGIKIPYYDSDTVIKAICLNLLNAGSDTLGITMTWALSLLLNNRHVLKKVKDELDVHVGKNRQVEELDVKNLVYLHAVVKETLRLFPPAPLGVPHEAMEDCVVGGFHVAKGTRLVVNVWKLHRDPSVWSDPLAFKPERFLDNNTVDVRGQHFQLLPFGSGRRGCPGITFALQVAHLTLARLLHGFEWDTPDGAPVDMSEVSVLTTAKKNPVEVLFTPRLPAEVYTQN

SEQ ID NO: 87 - protein, 527 aa, Nigella sativa
MLSIHDSTMVFLQLQAICGIFGFIFIITWWTRWKSSNKMKAPEVAGAWPVIGHLHLLGGGRPLYQLLGDMSDKYGPAFTLRMGIQKALVVSSWEVAKECLTTNDRALATRPSSAGGKYMGYNNALIPFSPYGPYWRDMRKIATLELLSNHRLEELKHVREMEINTCISDMYKLCQVEDGVEIKPISVDLSQWFADLTFNVVVMMITGKRYIGSTDAGDMNEIRHFQAALVKFMRLLRISLLVDVFPVLQWINYGGFKGVMKSTARDIDSVLENWLQEHQRKRLSPDFNGNHDFIDVMISTLEGTEFSDYDHNTIIKAISMAMVVGGTDTTTTTLIWAISLLLNNPNAMKKVQEELEIHVGKERNVDGSDIQHLVYLQAVVKETLRLYPPVPLSVMHQAMEDCVIGSYNIQAGTRVLFNLWKLHRDSSVWSDPLEFRPERFLTSHVDVDVRGQHFELIPFGSGRRSCPGISFALQVIHLTIARLFHGFNLTTPGNSSVDMSEISGATLSKVTPLEVLVTPRLSSKLYN

SEQ ID NO: 88 - protein, 525 aa, Hydrastis canadensis
MDSLLQLQIIGALAALIFTYKLLKVICRSPMTDGMEAPEPPGAWPIIGHLHLLGGQDPIARTLGVMTDKYGPILKLRLGVHTGLVVSNWELAKECFTTNDRVLASRPMGAAGKYLGYNYAIFGLAPHGPYWSEVRKIVLRELLSNQSLEKLKHVRISEINTCLKNLFSLNNGNTPIKVDMKQWFERPMFNVVTMMIAGKRYFSMENDNEAMNFRKVATEFMYLTGVFVVSDALPYLEWLDLQGHVSAMKRTAKELDIHVGKWLEEHRRAKLLGETKNEDDFVDVLLTILPEDLKDNQTYIHDRDTIIKATALALFLAASDTTAITLTWALSLILNNPDVLKRAQDELDKHVGKEKLVKESDIINLVYLQAIIKETLRLYPAAPLLLPHEAMEDCTVGGYHVPKGTRIFVNIWKLQRDPRVWFDPNEFRPERFLTTHANVDFKGQHFEYIPFSSGRRVCPGITFSTQIMHLTLAHLLHEFNIVTPTKSNAGVDMTESLGITMPKATPLEVLLTPRLPSNLYNQYRD

SEQ ID NO: 89 - protein, 550 aa, Eschscholzia californica
MNLLIFFQFLLQFQVLVGLSVLLAFSYYLWVSKNPKINKFKGKGALLAPQAAGAWPIVGHLPQLVGPKPLFRILGAMADNYGPIFMLRFGVHPTVVVSSWEMTKECFTTNDRHLASRPSNAASQYLIYEVYALFGFSLYGSSYWRDARKIATLELLSHRRLELLKHVPYTEIDTCIKQLHRLWTKNNKNQNNPELKVEMNQFFTDLTMNVILKLVVGKRFFNVDDAADHEKEEARKIQGTIFEFFKLTEGSVSAGALPLLNWLDLNGQKRAMKRTAKKMDSIAEKLLDEHRQKRLSKEGVKGTHDHNDFMDVLLSILDADQGDYSHHPFNYSRDHVIKATTLSMILSSMSISVSLSWALSLLLNNRHVLKKAQDELDMNVGKDRQVEEGDIKNLVYLQAIVKETFRMYPANPLLLPHEAIEDCKIGGFNVPAGTRVVVNAWKLQHDPRVWSNPSEFKPERFLNDQAAKVVDVRGQNFEYLPFGSGRRVCPGISFSLQTIHMSLARLVQAFELGTPSNERIDMTEGSGLTMPKTTPLHVLLNPRLPLPLYE

SEQ ID NO: 90 - protein, 537 aa, Glaucium flavum
MELINSLEIQPITISILALLTVSILLYKIIWNHGSRKNNKSNKNNRKTSSSAGVVEIPGAWPIIGHLHLFNGSEQMFHKLGSLADQYGPAPFFIRFGSRKYVVVSNWELVKTCFTAQSQIFVSRPPMLAMNILFFPKDSLSYIQHGDHWRELRKISSTKLLSSHRVETQKHLIASEVDYCFKQLYKLSNNGEFTLVRLNTWCEDMALNVHVRMIAGMKNYVAAPGSGEYGGQARRYRKALEEALDLLNQFTITDVVPWLGWLDHFRDVVGRMKRCGAELDSIFATWVEEHRVKRASGKGGDVEPDFIDLCWESMEQLPGNDPATVIKLMCKEHIFNGSGTSSLTLAWILSLIMNNPYVIKKAREELEKHVGNHRQVEESDLPNLLYIQAIIKEGMRLYTPGPFIDRNTTEDYEINGVHIPAGTCLYVNLWKIHRDPNVYEDPLEFKPERFLKNNSDLDLKGQNYQLLPFGAGRRICPGVSLALPLMYLTVSRLIHGFDMKLPKGVEKADMTAHGGVINQRAYPLEVLLKPRLTFQQA

SEQ ID NO: 91 - protein, 568 aa, Stylophorum diphyllum
MTIGALALLSFIYFLRVSVIKRTKYTNTAVTATNKLENDEDEANHSKRVVAPPEVAGAWPILGHLPQLVGLKQPLFRVLGDMADKYGPIFIVRFGMYPTLVVSSWEMAKECFTTNDRVLASRPASASGKYLTYNYAMFGFTNGPYWREIRKISMLELLSHRRVELLKHVPSTEIDSSIKQLYHLWVENQNQNKQGDHQVKVDMSQLLRDLTLNIVLKLVVGKRLFNNNDMDHEQDEAARKLQKTMVELIKVAGASVASDALPFLGWLDVDGLKRTMKRIAKEIDVIAERWLQEHRQKKLTSNDKGGSNNIQGGGGDNDFMDVMLSILDDDSNFFINYNRDTVIKATSLTMILAGSDTTTLSLTWALTLLATNPGALRKAQDELDTKVGRDRQVDERDIKNLVYLQAIVKETLRMYPAAPLAIPHEATQDCIVGGYHVTAGTRVWVNLWKLQRDPHAWPNPSEFRPERFLAVENDCKQQGTCDGEAANMDFRGQHFEYMPFGSGRRMCPGINFAIQIIHMTLARLLHSFELRVPEEEVIDMAEDSGLTISKVTPLELLLTPRLPLPLYI

SEQ ID NO: 92 - protein, 561 aa, Stylophorum diphyllum
FCQFQGIVGILLAFLTFLYYLWRASITGLRTKPKHNDFKVTKAAPEADGAWPIVGHFAQFIGPRPLFRILGDMADKYGSIFMVRFGMYPTLVVSSWEMAKECFTTNDRFLASRPASAAGKYLTYDFAMLSFSFYGPYWREIRKISMLELLSHRRVELLKHVPSTEIDSSIKQLYHLWVENQNQNKQGDHQVKVDMSQLLRDLTLNIVLKLVVGKRLFNNNDMDHEQDEAARKLQKTMVELIKVAGASVASDALPFLGWLDVDGLKRTMKRIAKEIDVIAERWLQEHRQKKLTSNDKGGSNNIQGGGGDNDFMDVMLSILDDDSNFFINYNRDTVIKATSLTMILAGSDTTTLSLTWALTLLATYPLCALRKAQDELDTKVGRDRQVDERDIKNLVYLQAIVKETLRMYPAAPLAIPHEATQDCIVGGYHVTAGTRVWVNLWKLQRDPHAWPNPSEFRPERFLAVENDCKQQGTCDGEAANMDFRGQHFEYMPFGSGRRMCPGINFAIQIIHMTLARLLHSFELRVPEEEVIDMAEDSGLTISKVTPLELLLTPRLPLPLYI

SEQ ID NO: 93 - protein, 561 aa, Chelidonium majus
MDLFIFFSRFQYIVGLLAFLTFFYYLWRVSITGTRIKTNQNIMNGTNMMAPEAAGAWPIVGHLPQLVGPQPLFKILGDMADKYGSIFMVRFGMHPTLVVSSWEMAKECFTTNDKFLASRPTSAGGKYLTYDFAMFGFSFYGPYWREIRKISTLELLSHRRVELLKHVPYTEIGGSIKQLYKLWMETQNQNKQRDDHQVKVDMSQVFGYLTLNTVLKLVVGKGLFNNNDMNHEQEEGRKLHETVLEFFKLAGVSVASDALPFLGWLDVDGQKRSMKRIAKEMDLIAERWLQEHRQKRLTSNNKASSGHDDFMSVLLSILDDDSNFFNYNRDTVIKATSLNLILAASDTTSVSLTWVLSLLVTNPGALKKVQDELDTKVGRNRHVEERDIEKLVYLQATVKETLRMYPAGPLSVPHEATQDCTVGGYQVTAGTRLVVNVWKLQRDPRVWPNPSEFKPERFLPDGCEVGCGEAANMDFRGQHFEYIPFGSGRRMCPGIDFAIQIIHMTLACLLHAFEFQVPSSLDKHLVPAVIDMSEGSGLTMPKVTPLEVLLNPRLPLPLYEL

SEQ ID NO: 94 - protein, 561 aa, Eschscholzia californica
MEKPILLQLQPGILGLLALMCFLYYVIKVSLSTRNCNQLVRHPPEAAGSWPIVGHLPQLVGSGKPLFRVLGDMADKFGPIFMVRFGVHPTLVVSSWEMAKECFTSNDKFLASRPPSAASIYMAYDHAMLGFSSYGPYWREIRKISTLHLLSHRRLELLKHVPHLEIHNFIKGLYGIWKDHQKQQQQPTARDDQDSVMLEMSQLFGYLTLNIVLSLVVGKRVCNYHADGHLDDGEEAGQGQKLHQTITDFFKLSGVSVASDALPFLGLFDLDGQKKIMKRVAKEMDFVAERWLQDKKSSLLLSSKSNNKQNEAGEGDVDDFMDVLMSTLPDDDDSFFTKYSRDTVIKANSLSMVVAGSDTTSVSLTWALSLLLNNIQVLRKAQDELDTKVGRDRHVEEKDIDNLVYLQAIVKETLRMYPAGPLSVPHEAIEDCNVGGYHIKTGTRLLVNIWKLQRDPRVWSNPSEFRPERFLDNQSNGTLLDFRGQHFEYIPFGSGRRMCPGVNLATPILHMTLARLLQSFDLTTPSSSPVDMTEGSGLTMPKVTPLKVLLTPRLPLPLYDY

SEQ ID NO: 95 - protein, 567 aa, Papaver bracteatum
MDVAIIVDHHYLQPFVSIAGLLALLSFFYCIWVFIIRPRIIKSNLDERKLSPSSPPEVAGAWPIVGHLPQLIGSTPLFKILADMSNKYGPIFMVRFGMYPTLVVSSWEMSKECFTTNDRLFATRPPSAAGKYLTKALFAFSVYGPYWREIRKISTIHLLSLRRLELLKHGRYLEIDKCMKRLFEYWMEHHKNIISTTSSVKVNMSQVFAELSLNVVLKIIVGKTLFIKNGNEDYTKEEEEGQKLHKTILKFMELAGVSVASDVLPFLGWLDVDGQKKQMKRVYKEMNLIASKWLGEHRERKRLQIIQKRGAARGSNYDDGNDFMDVLMSILDEENDDLFFGYSRDTVIKSTCLQLIVAASDTTSLAMTWALSLLLTNPNVLQKAQDELDTKVGRDRIIEEHDIECLVYLQAIVKETLRLYPPAPLSLPHEAMEDCTVGGYQVKAGTRLVVNLWKLQRDPRVWSNPLEFKPERFLPQSDGGFGGEEARMDFRGQHFEYTPFGSGRRICPGIDFFLQTVHMALARLLQAFDFNTAGGLVIDMVEGPGLTMPKVTPLEVHLNPRLPVTLY

SEQ ID NO: 96 - protein, 558 aa, Papaver bracteatum
MQVDWPNILQKYYPIITCSLLTLLSFYYIWVSITKPSRNSKTKLPPPEVAGSWPIVGHLPQLVGSTPLFKILANMSDKYGPIFMVRFGMHPTLVVSSWEMSKECFTTNDKFLASRPPSASAKYLGYDNAMFVFSDYGPYWREIRKISTLQLLTHKRLDSLKNIPYLEINSCVKTLYTRWAKTQSQIKQNVGGAADDFVKVDMTEMFGHLNLNVVLRLVVGKPIFIQKDNADEDYTKDGHNKEELGQKLHKTIIEFFELAGASVASDVLPYLGWLDVDGQKKRMKKIAMEMDLFAQKWLEEHRQKGINHDNENDFMAVLISVLGEGKDDHIFGYSRDTVIKATCLTLIVAATDTTLVSLTWALSLLLTNPRVLSKAQDELDTVVGKERNVEDRDVNHLVYLQAVIKETLRLYPPSPLAVPHEAIENCNVGGYEVKARTRLLVNLWKIHRDPRVWSNPLEFKPERFLPKLDGGTGEASKLDFKGQDFVYTPFGSGRRMCPGINFASQTLHMTLARLLHAFDFDIESNGLVIDMTEGSGLTMPKVTPLQVHLRPRLPATLY

SEQ ID NO: 97 - protein, 571 aa, Papaver bracteatum
MMDLAMFIDQYFSLAKIAGLLALLSFFYYLWISTLWSPRNPKLSSVSPPEVAGAWPILGHLPQLLGSRPLFKILADMSDNYGPIFMVRFGMHPTLVVSSWEMAKECFTTNDRFLAGRPSGAANKYLTFALFGFSTYGPYWREIRKIATLHLLSHRRLELLKHVPDLEVTNCMKHLHRRWIDSQNQIKQNDAAAGSVKVDMGRVFGELTLNVVLKLVAGKSIFFKNDNTRQYDSKDGHNKEEEEGKKLHKTIIDFYSLAGASVASDVLPFLGWLDVDGQKKRMKRVAKDMDFIAAKWLEEHRHQKRQTVLSSSATLGSSNHDDAKDFMDVLMSILDGENDDLFFGYSRDTVIKTTCLQLIAAAADTTSVTMTWALALLITNPTILRKAQDELDTKVGKDRNIEERDINDLVYLQAIVKETLRMYPAGPLNVPHEAIADCNIGGYEVRAGTRLLVNLWKMHRDPRVWSNPSEFKPERFLPQLDGGSGGEAANLDFRGQDFEYLPFSAGRRMCPGIDFSLQTLHMTLARLLHGFDFNNDSAGIIIDMEEGSGLTMPKLTPLEIYLCPRLPAKLY

SEQ ID NO: 98 - protein, 361 aa, Thalictrum flavum
MAVEGKQVAPKKAIIVELLKKLELGLVPDDEIKKLIRIQLGRRLQWGCKSTYEEQIAQLVNLTHSLRQMKIATEVETLDDQMYEVPIDFLKIMNGSNLKGSCCYFKNDSTTLDEAEIAMLELYCERAQIKDGHSVLDLGCGQGALTLYVAQKYKNSRVTAVTNSVSQKEFIEEESRKRNLSNVEVLLADITTHKMPDTYDRILVVELFEHMKNYELLLRKIKEWMAKDGLLFVEHICHKTFAYHYEPIDEDDWFTEYVFPAGTMIIPSASFFLYFQDDVSVVNHWTLSGKHFSRTNEEWLKRLDANVELIKPMFVTITGQCRQEAMKLINYWRGFCLSGMEMFGYNNGEEWMASHVLFKKK

SEQ ID NO: 99 - protein, 358 aa, Coptis japonica
MAVEAKQTKKAAIVELLKQLELGLVPYDDIKQLIRRELARRLQWGYKPTYEEQIAEIQNLTHSLRQMKIATEVETLDSQLYEIPIEFLKIMNGSNLKGSCCYFKEDSTTLDEAEIAMLDLYCERAQIQDGQSVLDLGCGQGALTLHVAQKYKNCRVTAVTNSVSQKEYIEEESRRRNLLNVEVKLADITTHEMAETYDRILVIELFEHMKNYELLLRKISEWISKDGLLFLEHICHKTFAYHYEPLDDDDWFTEYVFPAGTMIIPSASFFLYFQDDVSVVNHWTLSGKHFSRTNEEWLKRLDANLDVIKPMFETLMGNEEEAVKLINYWRGFCLSGMEMFGYNNGEEWMASHVLFKKK

SEQ ID NO: 100 - protein, 351 aa, Papaver somniferum
MQLKAKEELLRNMELGLIPDQEIRQLIRVELEKRLQWGYKETHEEQLSQLLDLVHSLKGMKMATEMENLDLKLYEAPMEFLKIQHGSNMKQSAGYYTDESTTLDEAEIAMLDLYMERAQIKDGQSVLDLGCGLGAVALFGANKFKKCQFTGVTSSVEQKDYIEGKCKELKLTNVKVLLADITTYETEERFDRIFAVELIEHMKNYQLLLKKISEWMKDDGLLFVEHVCHKTLAYHYEPVDAEDWYTNYIFPAGTLTLSSASMLLYFQDDVSVVNQWTLSGKHYSRSHEEWLKNMDKNIVEFKEIMRSITKTEKEAIKLLNFWRIFCMCGAELFGYKNGEEWMLTHLLFKKK

SEQ ID NO: 101 - protein, 358 aa, Papaver somniferum
MGSIDEVKKESAGETLGRLLKGEIKDEELKKLIKFQFEKRLQWGYKSSHQEQLSFNLDFIKSLKKMEMSGEIETMNKETYELPSEFLEAVFGKTVKQSMCYFTHESATIDEAEEAAHELYCERAQIKDGQTVLDIGCGQGGLVLYIAQKYKNCHVTGLTNSKAQVNYLLKQAEKLGLTNVDAILADVTQYESDKTYDRLLMIEAIEHMKNLQLFMKKLSTWMTKESLLFVDHVCHKTFAHFFEAVDEDDWYSGFIFPPGCATILAANSLLYFQDDVSVVDHWVVNGMHMARSVDIWRKALDKNMEAAKEILLPGLGGSHETVNGVVTHIRTFCMGGYEQFSMNNGDEWMVAQLLFKKK

SEQ ID NO: 102 - protein, 350 aa, Eschscholzia californica
MGSSAGEIMGRLMKGEIEDEELKKLIRHQWDRRIEWGYKPTHEKQLAFNLDFIKGLKEMVMSGEIDTMNKETYELPTAFLEAVFGKTVKQSCCYFKDENSTIDEAEEAAHELYCERAQIKDGQTVLDIGCGQGGLVLYIAEKYKNCHVTGLTNSKAQANYIEQQAEKLELTNVDVIFADVTKFDTDKTYDRILVVETIEHMKNIQLFMKKLSTWMTEDSLLFVDHISHKTFNHNFEALDEDDWYSGFIFPKGCVTILSSSTLLYFQDDVSALDHWVVNGMHMARSVEAWRKKLDETIEAAREILEPGLGSKEAVNQVITHIRTFCIGGYEQFSYNNGEEWMITQILFKKK

SEQ ID NO: 103 - protein, 363 aa, Papaver somniferum
MSTTMETTKISQQDDLWKNMELGQISDEEVRRLMKIGIEKRIKWGTKPTQQEQLAQLLDFNKSLRGMKMATEIDTLENHKIYETPESFNQIIGGKESAGLFTDETTTTMEEANTKMMDLYCERAGLKDGHTILDLGCGAGLLVLHLAKKYKKSKITGITNTSSHKEYILKQCKNLNLSNVEIILADVTKVDIESTFDRVFVIGLIEHMKNFELFLRKISKWMKDDGLLLLEHLCHKSFSDHWEPLSEDDWYAKNFFPSGTLVIPSATCLLYFQEDVTVIDHWILSGNNFARSNEVILKRIDGKIEEVKDIFMSFYGIGREEAVKLINWWRLLCITANELFKYNNGEEWLISQLLFKKKLMTCI

SEQ ID NO: 104 - protein, 356 aa, Thalictrum flavum
METKQTKKEAVANLIKRIEHGEVSDEEIRGMMKIQVQKRLKWGYKPTHEQQLAQLVTFAQSLKGMEMAEEVDTLDAELYEIPLPFLHIMCGKTLKFSPGYFKDESTTLDESEVYMMDLYCERAQIKDGQSILDLGCGHGSLTLHVAQKYRGCKVTGITNSVSQKEFIMDQCKKLDLSNVEIILEDVTKFETEITYDRIFAVALIEHMKNYELFLKKVSTWIAQYGLLFVEHHCHKVFAYQYEPLDEDDWYTEYIFPSGTLVMSSSSILLYFQEDVSVVNHWTLSGKHPSLGFKQWLKRLDDNIDEVKEIFESFYGSKEKAMKFITYWRVFCIAHSQMYSTNNGEEWMLSQVLFKKK

SEQ ID NO: 105 - protein, 358 aa, Papaver bracteatum
MGSIDEVKKESAGETLGRLLKGEIKDEELKKLIKFQFEKRLQWGYKSSHQEQLSFNLDFIKSLKKMEMSGEIETMNKETYELPSEFLEAVFGKTVKQSMCYFKHESATIDEAEEAAHELYCERAQIKDGQTVLDIGCGQGGLVLYIARKYKKCHVTGLTNSKAQVNYLLKQAEKLGLTNVDAILADVTQYESDKTYDRLLMIEAIEHMKNLQLFMKKLSTWMTEESLLFVDHVCHKTFAHFFEAVDEDDWYSGFIFPPGCATILAANSLLYFQDDVSVVDHWVVNGMHMARSVDIWRKALDKNMEAAKEILLPGLGGSHEAVNGVVTHIRTFCMGGYEQFSMNDGDEWMVAQLLFKKK

SEQ ID NO: 106 - protein, 358 aa, Papaver bracteatum
MGSIEEVKKESAEETLGRLLRGEINDEELKKLIKYQLEKRLQWGYKSSHQEQLSFNLDFINSLKKMGMSGQVEAFTNEVYELPTECFEAAYGKSMKLSGCYFKHESSTIDEAEEASHELYCERAQIKDGQTVLDIGCGQGGLVLYVAQKYKNCHVTGLTNSKEQVNYILKQAEKLGLRNVDVILADVTQYESDKTYDRILVIGVVEHMKNMQLFIKKLSTWMAEDSLLFVDHSCHKTFNHFFEALDEDDWYSGYIFPPGCATFLSADSLLYFQDDVSVVDHWVVNGMHFARTVDAWRKKLDKNMEAVKEILLPGLGGNHEAVNGVITHIRTCCVGGYVQFSLNDGDEWMNAQLLFKKK

SEQ ID NO: 107 - protein, 368 aa, Argemone mexicana
MCLFFAEKMGLMAEANNQQQLKKEDLLKNMELGLIPDEEIRKLIRVQLEKRLNWGYKSTHEQQLSQLLHLVHSLKKMKIATEMENLDLKLYEAPFSFVQIQHGSTIKESSGLFKDESTTLDEAEIAMLDLYTKRAKIEDGQSVLDLGCGLGAVTLYVAQKFKNCYVTGITSSVEQKDFIEGRCKELKLSNVKVILADITTYETEEKYNRIFAVELIEHMKNYELLLRKISEWMKQDGLLFIEHVCHKTLAYHYEPLDEEDWYTNYIFPAGTLTLSSATLLLYFQDDVAVVDQWTLSGKHYSRSHEEWLKRIDGNIEEVKEIMKSITKSEEEAKKLLNFWRIFCMCGAELFGYKNGEEWMMTHILFKKK

SEQ ID NO: 108 - protein, 364 aa, Glaucium flavum
MDLMATSKQVKKKEELLKNMELGLVPDEEIRRLIRIELEKRLKWGYKPTHQQQLAQLLDLVHSLKKMKIATEMESLDLKLYEAPFSFVQIKHGSTIKESSSYFKDESMTLDEAEIAMLDLYVERAQIEDGQSVLDLGCGLGAVTLHVAKKYKNCHVTGLTNSVEQKDFIEGKCKELNLSNVKVILADVTSHEMEDKFDRIFAVELIEHMKNYELLLRRISKWMKDDGLLFIEHVCHKTFAYHYEPIDEDDWYTEYIFPAGTLTLSSASLLLYFQDDVSVVNHWTLSGKHYSRSHEEWLKRIDGNMDAVKEIMKSITKTEEEAVKLINFWRIFCMCGAELFGYKDGEEWMMSHVLFKKKQLLQQC

SEQ ID NO: 109 - protein, 353 aa, Eschscholzia californica
MVDLKVEKEELLKSMELGLVPDEDIRKHIRSQLEKRLKWGYKPNHEQQLAQLLDVIHSLKKMKISKEYESFDLRLYEAPFDFHKIQLGTHLKESCSYYKDESTTLDEAEGAMLDLYTQKAKIEDGQSILDLGCGVGAVTLFVANKYKNCKVTGITSCQWQKDFIENKCKELNLTNVRVIIGDVTAYEMEETFDRIFAIELIEHMKNYELLLRKISKWMKDDGLLFIEHVCHKILAYPYEPIDEEDWFTEYIFPGGTLTLSSASLLLYFQDDVSVVEHSSLNGKHYSRSHGEWLKNIDANIDEVKGIMRSITKTEEEAVRLVNFWRIFCMCGIELFGYNNGEEWMVSHILLKKK

SEQ ID NO: 110 - protein, 359 aa, Eschscholzia californica
MAADLVVKKWNNKKELIDEMELGLVGDEEIRELIRNDLEKRLKWGYKSNHEQQLAQLLHFVHSLRGMKIAADEVESFNIKVYEAPFSFNKIQLGSSLKESSCYYKHDETTLDEGEIAMMELYTEKAQIKDGQSVLDLGCGLGSLTLYVANKYPNCKVTGTTASLWHKDFIESKCKEQELTNVKIVLGDATTHEMEERFDRILAIGLIEHLKNYGLLLGRISKWLKDDGFLFIQHVCHKTLAYPLVPVDEEDWIGEYIFPGGTLTMPSASLLLYFQDELSVVDHSTLNGKHFSRTHEEWLKNIDAKIDEVKEILKSVTKTEEEVVRLTNFWRIFCMFGVEMFGYNEGEEWMLSQILFKKK

SEQ ID NO: 111 - protein, 353 aa, Chelidonium majus
MASGKVVDLLKRLDSGLVSDEELRRVIRFELERRLKWGYKPTHEQQLAELLNLAHATKQMEIATKIDTLNSTMYEVPNSFLEIQLGSTLKESCLYFKDESTTVDEAEIAMMDLYLERAQIKDGQIILDLGCGLGALAFHIAQKYTNCNVTSVTNSVKQKEFIEEKCKILNVSNVKVILTDICTLEMEATFDRIFAIGLIEHMKNYELLLRKFSAWMKQDGLLFIEHLCHKTLGYHNEPIDEDDWYTAYFFPAGTLTFIPSSFLLYFQDDVSVVNHWTLSGKHFSRSNEEWLKRMDNKIDEVKEIYKAAASETKDDDIMKLIRLWRFLSISAAEMFGYKDGEEWMISQVLFKKK

SEQ ID NO: 112 - protein, 366 aa, Eschscholzia californica
MASLVEEGSFVNNKESVKERVSELVKRLKNGLVSDEELRKLMRVELEKRLEWGYKSTHEQQLSQLIDLAHSMKKMEIAMEIDALNSTVYEVPLSFLQIIHGTTIKESCLYFKDESTTVDEAEIAMMDLYLERAQIKDGQSILDLGCGLGGFSFHIASKFTGCNITAVTNSVKQKEFIEEKCKTLNVPNIKVILADICTTEIENVFDRIIAIGLIEHMKNYELLLKKFSKWMTQDGLLFIEHLCHKTFGYHNEPLDEDDWYTTYFFPAGTLTFIPSSFLLYFQDDVSVVDHWTLNGKHFARSNEEWLKRMDEKMDEVKQIFRSNLKSENEVTKTIGEWRFLSMSAAEMFGYNNGEEWMVSQLLFKKK

SEQ ID NO: 113 - protein, 362 aa, Glaucium flavum
MGSNETNGELKTKEMVPDLLKRLESGLVADEELRKLIRFELERRLKWGYKPTHEQQLAELLKLAHSTKQMKIATETDSLNSTMYEVPIPFLQLQFGSAIKESCCYFKDESTTLDEAEVAMMDLYLERTQIKDGQSILDLGCGLGALAFHIVQKYPNCNVLAITNSVEQKEFIEEKCKIRKVENVKVSLADICTLEMKTTFDRIFAIGLLEHMKNYQLLLKKFSNWMKQDGLLFIEHLCHKTLAYHYEPLDEDDWYTEYFFPAGTLTIISSSFLLYFQDDVSIVNHWSLSGKHFSRSNEEWLKRMDMKIDEVKEILEAAFENKDHDITKLINHWRFLAINATEMFGYNNGEEWMVSQVLFKKK

SEQ ID NO: 114 - protein, 365 aa, Sanguinaria canadensis
MASDHEVSNKELKKKKEVITELLKRLESGLVSDEELRGLIRFELERRLRWGYKPTHEQQLAQLLNLAHSMKQMKIATEIDALNSTMYEVPIPFLQIQLGSTLKESCCYFKDESTTVDEAEIAMMDLYLERAQIKDGQSILDLGCGLGALAFHIAQKYTNCNITAITNSVRQKEFIEEKCKILNVSNVKVSLADICTLEMEATFDRIFAIGLIEHMKNYELLLKKFSEWMKQDGLIFIEHLCHKTLAYHYEPLDEDDWYTEYFFPAGTLTLISSSFLLYFQDDVSVVDHWTLSGKHFSRSNEEWLKRMDEKIDEVKEIFESVSDSKDDDVTKLINHWRFFCISSAEMFGYNNGEEWMISQVLFKKK

SEQ ID NO: 115 - protein, 371 aa, Corydalis chelanthifolia
MIKKSKIMAFSDHHHEVVKNHSKKEMIADLLKRLEAGLVPDEEMRNLFRFELERRLQWGYKSIHQEQLSQLLKLAHSTKEMTIVAEMDALNSSMYELPISFLQIQLGSNLKQSSLYFKDELTTVDEAEVAIMDLYLERAQIEDGQSILDLGCGLGAFSFHVARKYTNCNITAVTNSLTQKEFIEKKSKILNIQNVKVIFADVTTVEMETTFDRVFAIGLIEHMQNYELFLKKLSKWMKQDGLLFIEHFCHKTLAYHYKPIDEDDWFTNLLYPNGTVISSSLLLYFQDDVSVVDHWSLSGKHFSRASEESLKRMDAKMDEMKEIFESITDSKEEAMKLINQWRIFCISCAEMFGYNNGEEWMTSHFLFKKKL

SEQ ID NO: 116 - protein, 373 aa, Corydalis chelanthifolia
MGSSTASDHEMVIMENDSKNKQVVIADLLKRLVGGLVPDEEMRNMFRFELEKRLKWGYKSTHQQQLSQLLNLVELNKGIAKIAPEMDALNSAMYEVPIPYLKLMLGSTLKQSCLYFKDESTTLDEAEIEMMDLYLERADIQDGQSILDLGCGLGGLGFHIAQKYISCNITALTNSLTQKEFIEEKCKTLNIPNVKVILADVTTVEIETTFDRLFAIGLVEHMENYELFLRKLSKWMKQDGLLFIEHLCHKTLAYHYKPIDEDDWYSNLLYPTGTLTSASFLLYFQDDLSVVDHWSLSGKHFSRATEEWLKMIDANMDKIREIYESVTESKEEATRSINQWRIFCISCAEMFGYNDGEEWMISHFLFKNKKQIE

SEQ ID NO: 117 - protein, 366 aa, Corydalis chelanthifolia
MATSDQEVKTSKMEMIADLLKRLEAGLVPDDEIRSLIRVELERRLKWGYKSTHQEQLDQLLNLAHSIKKMKIASTEMDGLTSTMYEVPISLVQIQLGSHLKESCLYFKDETTTVDEAEIAMMDLYLERAQIKDGQSILDLGCGLGAVSFHIAQKYTSCNITAVTNSVRQKEFIEEKSKTLNVPNVKVLLADITTLEMEHTFDRLFAISLIEHMENYELLLRKLSEWMKQDGLLFIEHLCHKTLSYHFEPMDEDDWYTNLLFPAGTLTLVSASFLLYFQDDLSVVNQWVMSGKHFSRANEEWLKNMDAKMDEMREIFESITDSEEEVVKLINHWRIFCISSAEMFAYNDGEEWMNSHVLFKKKKQIQ

SEQ ID NO: 118 - protein, 359 aa, Corydalis chelanthifolia
MAGSGANKEMIADLLKRLEVGLVPDEEIRSLIRFQLKRRLKWGYKTTHQEQLEQLLSLAHSIRKMKIATEMDALNSTMYEVPISFMQIVFGSTLKESCLYFKDEATTVNEAEIAMMDLYLERAQIKDGQSILDLGCGMGSLCFHIARKYTNCNITAVTNSVSQKEFIEEKSKTLNLPNVKVILADITTLEMDDTYDCLFAIGLIEHMKNYELLLRKLSNWMKQDSLLFIDHVCHKTLAYHYEPIDEDDWYTNLLFPAGTLTLVSASFLLYFQDDLSLVDHWSMSGKHFSRTNKEWLKNIDGKMDKIREIVKSITDSEEEVVKLINHWRMLCINSSEMFGFNDGEEWMNSHVLFKKKKQI

SEQ ID NO: 119 - protein, 353 aa, Sanguinaria canadensis
MEMIADLLKRLEAGLVPDDEIRSLIRVELERRLKWGYKSTHQEQLDQLLNLAHSIKKMKIASTEMDGLTSTMYEVPISLVQIQLGSHLKESCLYFKDETTTVDEAEIAMMDLYLERAQIKDGQSILDLGCGLGSVCFHIARKYTSCNITAVTNSVSQKEFIEEKSKTLNVPNVKVLLADITTLEMDDTFDCLFAIGLIEHMENYELLLRKLSDWMKQDGLLFIDHVCHKTLSYHFEPMDEDDWYTNLLFPAGTLTLVSASFLLYFQDDLSLVDHWSMSGKHFSRTNKEWLKNIDGKMDKIREIVKSITDSEEEVVKLINHWRMLCINSSEMFGFNDGEEWMNSHVLFKKKKQI

SEQ ID NO: 120 - protein, 363 aa, Papaver bracteatum
MCTTMDTTKISQQDDLWKNMELGLISDEEVRRLMKIETEKRIKWGTKPTQQEQLAQLLDFNKSLRGMKMATEVHALENHKIYEIPDSFNQIIGGKESAGLFTDEATTTIEEANTKMMDLYCERAGLKDGQTILDIGCGAGLLVLHLAKKYKNCKITGVTNTSWHKEHILEQCKNLNLSNVEVILADVTTVDIERTFDRVFVIGLIEHMKNFELFLRKISKWMKDDGLLFLEHLCHKSFSDHWEPLSEDDWYAKNFFPSGTLVIPSATCLLYFQEDVTVKDHWLLSGNNFARSNEAILKRIDSKIEEVKDIFMSFYGIGEEEAVKLINWWRLLCITANELFKYNNGEEWLISQLLFKKKLMTCI

SEQ ID NO: 121 - protein, 366 aa, Papaver bracteatum
MVKGDQFQTTTMEETKISQENDLWTNMELGLIPDEEVRRLMKIEIEKRIEWGMKPTQHQQLAQLLDFTKSLRGMKMATELDKLDSKLYETPHSFNQIVNGSTLKESSGLYTDVTTTMDEASIKMMDLYCERANIKDGQTILDLGCGPGPLVLHIAKKYSNCKITGVTNAFSQREYILEECKKLSLSNVEIILADVTSLDLETTFDRVFVIGFIEHMKNFELFLRKISKWMKDDAVLFLEHFCHKSFSYHGEPLSEDDWYAKNFFAPGTLVIPSATCLLYFQEDLAVIDHWFLSGNHFARTNEEMLKGIDGKIEEIKDIFMSFYGINEAEAVKLINWWRLFCITGAEMFSYNNGEEWFISQLLFKKK

SEQ ID NO: 122 - protein, 364 aa, Eschscholzia californica
MALEQEDSMSVPERNEGVADLIKRMELGLVNDEEIRRLMRIQIENRLKWGYKPTHDQQLAQHLHFINSLKEMKMATEMDSLDSQVYESPNSFQQIMCGRSMKESAGLFMDDVTTVEEAHIRMMDLYCDKATFEDGQKILDLGCGHGSVVLHVAQKYKGCQVTGVTNSSAQKQYILEQCKKLDLSNVEIILADVTTLEMEEKFDRVIIIGLIEHMKNFKLFFQKVSKWMKEGGLLFLENYFHKDFAYHCEKIDEDDWYDGYIFPPGSLLMPSASTLLYFQEDLTVADHWVLPGTHFAKTFEEFLKKIDLRIEEVREIFEAFYGISKEEAMKLSNYWRNFCISAMEIFNYNNGQEWMISHLLYTKK

SEQ ID NO: 123 - protein, 368 aa, Chelidonium majus
METGKNNQNMKTTIDDLWNQMMLGIVPDKEIRRLMKIELKKRLDWGYRPTHQQQLSQLLDFAKGLCNYCWTALRCMKMSAEFDTLDSKVYETPKSFQQIMCGTTIKESSGLFMNESTTLDQAQISMLDLYFDKAKIKDGQSILDLGCGHGALILYLAQKYQNCNITGVTNSLSQKEFIVEKCKKLGLSNVEILLADVTKLEMEDMFDRVFVIGLIEHMKNFELFLRKISEWMKPDGLLFLEHYCHKSFAHQWEPIDEEDWFSKYIFPPGTVIIPSASFLLYFQEDVKVIDHWTLSGNHFARTQEEWLKGIDGHIDEVEKTFESFYGISKEEAVKLINFWRVFCLSGVEMFGYNNGEEWMISHLLFKKK

SEQ ID NO: 124 - protein, 361 aa, Glaucium flavum
MTMEANNAKKEAIENLWEQMMMGLVPDHEITRLMKSELQKRLNWGYKPTHQQQISQLLDFAKSLRRMEMSLDFDNLELDTKMYETPESFQLIMSGTTLKESSGLFTDETATLDQTQIRMMDLYLEKAKIKDGQSILDLGCGHGALILHVAQKYRNCNVTGVTNSIAQKEFIFKQCKKLGLSNVEMVLADVTKCEMKATFDHIFVIGLIEHMKNFELFLRKVSEWMKSDGLLFMEHYCHKSFAYQWEPMDDDDLFSKYVFPPGSAIIPSASFLLYFQDDLTVVDHWTLSGNHFARTHQEWLKRIDSQSDEIKGIFESFYGISKEEAVKLINYWRVFCLFGVEMFGYNNGEEWMISHLLFKKK

SEQ ID NO: 125 - protein, 363 aa, Corydalis chelanthifolia
MEVVATSSARNPKKEIVDLWKRMELGLIPDEEIRDLMKIGLEKRLKWGYKPTHEQQLSQLLHFAKSLRSMKMASEMETLDDQMYETPTAFQQLMCGSTIKESAGFFKDESTTLDEAEIKMLDLYCEKARIEDGQKILDLGCGHGAVMLHIAQKYKNCNVTGVTNSISQQQFIVQRSKELNLSNVNMILADVTMLEMDATYDRIFIIGLIEHMKNFELFLRKISKWITKEGLLFLEHYCHKTFAYQCEPVDEDDWYNMFIFPPGTLILPSASFLLYFQDDLIVVDRWTLNGNHYARTQEEWLKRIDANVDGVKQMFESVCDGNKEEAVKLMNFWRIFCISGAEMLAYNNGEEWMISHYLFKKRN

SEQ ID NO: 126 - protein, 357 aa, Nigella sativa
MEATQITKKQGVAELIKRIENGQVPDEEITRMMKIQIQKRLKLGYKSTHEQQLAQLLHFVHSLQKMEMAEEVDTLDSELYEIPLPFLHIMCGKALKFSPGYFKDESTTLDESEVNMLDLYCERAQIEDGQTILDLGCGHGSLTLHVAKKYRGCKVTGITNSVSQKDFIMEECKKLNLSNVEIILEDVTKFETGTTYDRIFAVALIEHMKNYELFLKKVSAWMAQDGLLFVEHHCHKVFAYKYEPIDDDDWYTEYIFPTGTLVMSSSSILLYFQEDVSVVNHWTLSGKHPSLGFKQWLKRIDDNIDEIKEIFESFYGSKEKATKFITYWRVFCIAHSEMYATNGGEEWMLSQVLFKRK

SEQ ID NO: 127 - protein, 349 aa, Sanguinaria canadensis
MGGVADLLKKMELGLVPEEEIRRLMRIIIEKRLEWGYKPTHAEQLDHLTNFIQCLRGMKMADEIDALDAKMYEIPLPFMQTICGSTLKFSPGYFKDESTTLDESEIHMMDLYCERAEVKDGHSILDLGCGHGGFVLHVAQKYKNSIVTGVTNSVAEKEFIMTQCKKLCLSNVEIILADVTKFEPETTYDRVFAIALIEHMKNYELVLEKLSKWVAQDGFLFVEHHCHKVFPYKYEPLDEDDWYTEYIFPGGTIVLPSASILLYFQKDVSVVNHWSLNGKHPARGFKEWLKRLDENMDAVKAIFEPFYGSKEEAMKWITYWRVFCITHSEMYAYNNGEEWMLSQVLFKRK

SEQ ID NO: 128 - protein, 350 aa, Jeffersonia diphylla
MSKGVAKLVERMELGLVSDDEVRRLMRILIEKRLKWGYKPTHEEQLTYLTNFIQGLKGMKIAEEIDALDAKMYEIPIAFMQILCGYSLKFSPGFFEDESTTLDESETIMMDLYCERAQVQDGQSILDLGCGHGGFVLHVAQKYKNCKVTGVTNSVSETEYIMEQCKKLGLSNVEIIIADVTKFEPEVTYDRVFAIALIEHMKNYELVLQKLSKWVAQDGFLFVDHHCHKVFPYKYEPIDEDDWYTQYIFPGGTLVLPSASILLYFQEDVSIVNHWTLSGNHPARGFKEWLKRLDDNMDEIKAIFEPFYGSKEEAMKWITYWRVFCITHSEMYAYNGGEEWMISQVLFKRK

SEQ ID NO: 129 - protein, 357 aa, Berberis thunbergii
MEVKQAGKEGVTELLVKRMELGLVPEEEIRRLMRIQIQKRLDWGYKPTHEEQLAHLTKFIQNIRGMKMADEIDALDAKMYEIPLPFLQTICGKTLKFSPGYFKDESTTLDESETLMMDLYCERAQVKDGQSILDLGCGHGGFVLHLAQKYRNSVVTGVTNSVSETEYIKEQCKKLGLSNVEIIIADVTKFEPEVTYDRVFAIALIEHMKNYALVLNKISKWVAQDGYLFVEHHCHKVFPYKYEPLDEDDWYTNYIFPGGTLILPSASILLYFQEDVTVLNHWSLSGKHPSRGFIEWLKRLDENIDVIMGIFEPFYGSKEEATKWINYWRVFCMTHSEMYAYGNGEEWMLSQVLLKRK

SEQ ID NO: 130 - protein, 339 aa, Mahonia aquifolium
MELGLVPEKEIRRLMRIQIQKRLEWGYKPTHEEQLAHLTKFIQNIRGMKMADEIDALDAKMYEIPLPFLQTICGKTLKFSPGYFKDESTTLDESETLMMDLYCERAQVKDGQSILDLGCGHGGFVLHLAQKYRNSIVTGVTNSVSETEYIKEQCKKLGLSNVEIIIADVTKFEPEVTYDRVFAIALIEHMKNYALVLNKISKWVAQDGYLFVEHHCHKVFPYKYEPLDEDDWYTNYIFPGGTLILPSASILLYFQEDVTVLNHWSLSGKHPSRGFIEWLKRLDENIDVIMGIFEPFYGSKEEATKWINYWRVFCITHSEMYAYGNGEEWMLSQVLLKRK

SEQ ID NO: 131 - protein, 355 aa, Menispermum canadense
  MOD_RES (86)..(86): Any amino acid
  MOD_RES (96)..(96): Any amino acid
  MOD_RES (127)..(127): Any amino acid
  MOD_RES (138)..(138): Any amino acid
  MOD_RES (153)..(153): Any amino acid
  MOD_RES (292)..(292): Any amino acid
MDKANERELKRAELFKKLEDDLVTYDEIKQVMRTELAKRLEWGYKPTHQQQLAHLLDFAHALEGMKIANEVETLASEVYETPLPFXEIVLGPAKKXSSCLFEDESTTLEQAEIAMLDLYFERAQIRXGMSVLDLGCGXGSVGLHIARKYKNCXVTCITNSISQKQYIENQCKLYNLSNVKIILADIVAHDTDDTFDVVLVIGVIEHMKNYALLLNKISKWMAKDGLLFVEHLCHKTFPYHFEPLDEDDWYSNFVFPTGTLTMPSVSFLLYFQADVSILNHWILSGKNFSRTXEEFLKRIDANVDAIKDGLKPSLGSEGVAKLISYWRGFCLTGMEMFGYNNGEEWMVSQVLFKNK

SEQ ID NO: 132 - protein, 366 aa, Tinospora cordifolia
MEDNNNLLQEEMNVVELLQRPELGLVPDEKIRKLTRLQLQKRLKWGYKPTHEAQLSHLFQFIHSLPSLNMESEDENPKSWLYETPTSFLQLLYGDCIKESDTYYKEDTATLEEAVINMLELYCERARITEGLSVLDLGCGYGALTLHVAQKYKSCKVTGVTSSISQKQYIMEKCKKLNLTNVEIILADVATIEIEAASYDRIFALGIFEHVNDYKLFLGKLSKWMKQDGLLFVEYLCHKTFPYQNKPLDKGDKWYNEYVFPSGGLIIPSASFILYFQNDVSVVRQWTQGGQHSARTFEELLKRIDGNIDKIKEIFIESYGSKEDAVRFINYWRVFLITGVEMFSYNDGEEWMGAHFLFKKKFIMQE

SEQ ID NO: 133 - protein, 359 aa, Cissampelos mucronata
MEVKQSKGDELRSRVAELLERPELGLVPDEEIRRLAKARLEKRLKWGYKATHGEQLSSLLQFVESLPSLNMASEDDSPKAWLYETPTSFLQLIYGDIIKESGSYYKDESTTLEEAMIHNMNLCCERANIKEGQSVVDLGCGYGAFILHVAQKYKTCRVTGITSSISQKHYIMEQCKKLNLSNVEVILADVATIKLDATFDRVFAAGMFEHVNDYKSFLRKITNWMKPDGRLFVEHLCNKTFPYQNKPLDDGDNWGEYVFPSGGLIIPSASLLLYFQEDVSIVNHWTFSGKHAANKFEELLKRIDAKIDAIKRIFNECYGSKDSIRFINYWRVFLITAAEMFGYNNGEEWMGVHLLFKKK

SEQ ID NO: 134 - protein, 352 aa, Cocculus trilobus
GLKSSVAELLERPELGLVPDGEIRKLTKTRLAKRLEWGYKATHEDQLSHLLRFIHSLPSLNMASEDDSPKAWLYETPTSFLQLIYGDIIKESGTYYKDESSTLEEAIIHNMDLCCERARIKEGQSVLDLGCGYGAFTLHVAQKYKSCSVTGITSSISQKDYIMEQCKKLNLSNVEVILADVATIKMNTTFDRVFALGMFEHINDYKLFLRRISNWMKHDGLLFVEHLCNKTFAYQNKPLDDGDDWFNEYVFPSAGLIIPSASLLLYFQEDVSIVHHWTFSGKHAAYKFEELLERIDAKIEAIKEIFIECYGSKEDAIRFINYWRVFLITAAEMFAYRDGEEWMGSHVLFKKK

SEQ ID NO: 135 - protein, 364 aa, Cissampelos mucronata
MEAKQHESNNNIDEELKNRVNIGEQEERPGFEDEEIRRLAKAQLAKRLKWGYKPTHEQQLSHLLQFLQSLPSLNMASEDESSKAWLYETPTSFLQLLFGNVIKFSGYYYKHESSTFEESMIHNMDLCCERANIKEGQNVIDLGCGYGAFVLHVAQKYKSCSVTGITCSITQKHHIMEECKKLNLCNVKVILADVATIELGTAFDRVFAFGMFEEINDYKLILRKISNWMKPDGLFFVEHLCHKTLAYQNKLIDDQDWYEEYIFPSGGLIVPSASLLLYFQDDLSVVYHWTYNGKHGARSFEKMLERTDANIDTIKDMFTEFYGSKEKAIKFINYWRVFFITAAEMFAYNDGEEWMCSQLLFKKK

SEQ ID NO: 136 - protein, 364 aa, Cissampelos mucronata
MEHKIEDIRKLKSRVEEQLERPELGLVKDEDIKTLAKAKLEKRLKWGYKPTYAEQLSNLLQFAQSLPSLKMENVDDQGSSKQWLYGVPSEFLQIIYGGIIKMSGSYYEDESTTLEESMIKDMDSCCEKANVKEGHSVLDIGCGYGSLIIHIAKKYRTCNVTGITNFVEQKQYIMEECKKLNLSNVEVIVGDGTTINLNTTTFDRVFVTGMLEEINDYKLFLKSVSDWMKPDGLLLVTHFCHKTFAYQNNKALDDEDWHNEYIFPSGNLIVPSASLLLYFQEDLSVVSHWATNGTHTGRTCKKLVERIDANIEKIKEIFSEFYGSKEDAIRMINYWRVLCITGAEMYTCKDGEEWMDVYYLFKKK

SEQ ID NO: 137 - protein, 1049 aa, Artificial Sequence
  Description of Artificial Sequence: Synthetic polypeptide
MTIKEMPQPKTFGELKNLPLLNTDKPVQALMKIADELGEIFKFEAPGRVTRYLSSQRLIKEACDESRFDKNLSQALKFARDFAGDGLVTSWTHEKNWKKAHNILLPSFSQQAMKGYHAMMVDIAVQLVQKWERLNADEHIEVSEDMTRLTLDTIGLCGFNYRFNSFYRDQPHPFIISMVRALDEVMNKLQRANPDDPAYDENKRQFQEDIKVMNDLVDKIIADRKARGEQSDDLLTQMLNGKDPETGEPLDDGNIRYQIITFLIAGHETTSGLLSFALYFLVKNPHVLQKVAEEAARVLVDPVPSYKQVKQLKYVGMVLNEALRLWPTAPAFSLYAKEDTVLGGEYPLEKGDEVMVLIPQLHRDKTVWGDDVEEFRPERFENPSAIPQHAFKPFGNGQRACIGQQFALHEATLVLGMMLKHFDFEDHTNYELDIKETATLKPKGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 138 - protein, 1049 aa, Artificial Sequence
  Description of Artificial Sequence: Synthetic polypeptide
MTIKEMPQPKTFGELKNLPLLNTDKPVQALMKIADELGEIFKFEAPGRVTRYLSSQRLIKEACDESRFDKNLSQALKFARDFAGDGLVTSWTHEKNWKKAHNILLPSFSQQAMKGYHAMMVDIAVQLVQKWERLNADEHIEVSEDMTRLTLDTIGLCGFNYRFNSFYRDQPHPFIISMVRAADEVMNKLQRANPDDPAYDENKRQFQEDIKVMNDLVDKIIADRKARGEQSDDLLTQMLNGKDPETGEPLDDGNIRYQIIAFLIAGHETTSGLLSFALYFLVKNPHVLQKVAEEAARVLVDPVPSYKQVKQLKYVGMVLNEALRLWPTAPAFSLYAKEDTVLGGEYPLEKGDEVMVLIPQLHRDKTVWGDDVEEFRPERFENPSAIPQHAFKPFGNGQRACIGQQFALHEATLVLGMMLKHFDFEDHTNYELDIKETATLKPKGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 139 - protein, 1049 aa, Artificial Sequence; identical to SEQ ID NO: 83
  Description of Artificial Sequence: Synthetic polypeptide

SEQ ID NO: 140 - protein, 1049 aa, Artificial Sequence
  Description of Artificial Sequence: Synthetic polypeptide
MTIKEMPQPKTFGELKNLPLLNTDKPVQALMKIADELGEIFKFEAPGRVTRYLSSQRLIKEACDESRFDKNLSQAAKFARDFAGDGLVTSWTHEKNWKKAHNILLPSFSQQAMKGYHAMMVDIAVQLVQKWERLNADEHIEVSEDMTRLTLDTIGLCGFNYRFNSFYRDQPHPFIISAVRAADEVMNKLQRANPDDPAYDENKRQFQEDIKVMNDLVDKIIADRKARGEQSDDLLTQMLNGKDPETGEPLDDGNIRYQIITFLIAGHETTSGLLSFALYFLVKNPHVLQKVAEEAARVLVDPVPSYKQVKQLKYVGMVLNEALRLWPTAPAFSLYAKEDTVLGGEYPLEKGDEVMVLIPQLHRDKTVWGDDVEEFRPERFENPSAIPQHAFKPFGNGQRACIGQQFALHEATLVLGMMLKHFDFEDHTNYELDIKETLTLKPKGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 141 - protein, 1049 aa, Artificial Sequence
  Description of Artificial Sequence: Synthetic polypeptide
MTIKEMPQPKTFGELKNLPLLNTDKPVQALMKIADELGEIFKFEAPGRVTRYLSSQRLIKEACDESRFDKNLSQAAKFARDFAGDGLVTSWTHEKNWKKAHNILLPSFSQQAMKGYHAMMVDIAVQLVQKWERLNADEHIEVSEDMTRLTLDTIGLCGFNYRFNSFYRDQPHPFIISAVRAADEVMNKLQRANPDDPAYDENKRQFQEDIKVMNDLVDKIIADRKARGEQSDDLLTQMLNGKDPETGEPLDDGNIRYQIIAFLIAGHETTSGLLSFALYFLVKNPHVLQKVAEEAARVLVDPVPSYKQVKQLKYVGMVLNEALRLWPTAPAFSLYAKEDTVLGGEYPLEKGDEVMVLIPQLHRDKTVWGDDVEEFRPERFENPSAIPQHAFKPFGNGQRACIGQQFALHEATLVLGMMLKHFDFEDHTNYELDIKETLTLKPKGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 142 - DNA, 3150 bp, Artificial Sequence
  Description of Artificial Sequence: Synthetic polynucleotide
atgaccatcaaagaaatgccacaacctaagactttcggtgaattgaagaatttgcctttgttgaacaccgataagccagttcaagctttgatgaagattgctgatgaattgggtgaaatcttcaagtttgaagctccaggtagagtcactagatacttgtcatctcaaagattgatcaaagaagcctgcgacgaatccagatttgataagaatttgtctcaagctttgaagttcgctagagattttgctggtgatggtttggttacttcttggactcacgaaaagaattggaagaaggcccataacattttgttgccatctttctcacaacaagccatgaagggttatcatgctatgatggttgatatcgccgttcaattggttcaaaagtgggaaagattgaacgccgatgaacatatcgaagtctctgaagatatgaccagattgaccttggataccattggtttgtgtggtttcaactacagattcaactccttctacagagatcaaccacatccattcatcatctctatggttagagctttggatgaagtcatgaacaaattgcaaagagctaatccagacgatccagcttatgacgaaaacaagagacaattccaagaagatatcaaggtcatgaacgatttggtcgataagattatcgctgatagaaaggctagaggtgaacaatctgatgatttgttgacccaaatgttgaacggtaaggatccagaaactggtgaaccattggatgatggtaacatcagataccaaattatcaccttcttgattgctggtcacgaaactacatctggtttgttgtcttttgccttgtactttttggttaagaacccacacgtcttgcaaaaggttgctgaagaagctgcaagagttttggttgatccagttccatcttacaagcaagtcaagcaattgaagtacgttggtatggttttgaacgaagctttgagattgtggccaactgctccagctttttcattatacgctaaagaagataccgtcttgggtggtgaatatccattggaaaaaggtgatgaagttatggtcttgatcccacaattgcatagagataagactgtttggggtgatgatgtcgaagaattcagaccagaaagattcgaaaacccatctgctattccacaacatgcttttaagccatttggtaacggtcaaagagcttgcattggtcaacaattcgctttacatgaagctaccttggttttgggtatgatgttgaaacacttcgacttcgaagatcacaccaactacgaattggatatcaaagaaaccgctaccttgaagccaaagggttttgttgttaaggctaagtccaaaaagattccattgggtggtattccatctccatctactgaacaatccgctaagaaggttagaaagaaagctgaaaacgctcataacacacctttgttggtcttgtacggttctaatatgggtactgctgaaggtacagcaagagatttggcagatattgctatgtctaaaggtttcgctccacaagttgctactttggattctcatgctggtaatttgccaagagaaggtgctgttttgatagttactgcttcttacaatggtcacccaccagataatgctaagcaattcgttgattggttggatcaagcttcagctgatgaagtaaaaggtgttagatactctgttttcggttgcggtgacaaaaattgggctactacttatcaaaaggttccagcctttattgacgaaactttggctgctaaaggtgctgaaaacattgctgacagaggtgaagctgatgcctccgacgacttcgaaggtacttacgaagaatggagagaacacatgtggtctgacgttgctgcttacttcaacttggacatcgaaaactctgaagacaacaagtccactttgtctttgcaattcgttgactccgctgctgacatgccattggctaagatgcacggtgctttctctaccaacgtcgttgcctccaaggaattgcaacaaccaggttctgctagatctactagacacttggaaatcgaattgccaaaggaagcttcctaccaagaaggtgaccacttgggcgttattccaagaaactacgaaggtatcgtcaacagagttactgctagattcggtttggatgcttctcaacaaatcagattagaagctgaagaagaaaagttggctcacttgccattagctaagactgtctccgttgaagaattgttgcaatacgtcgaattgcaagacccagttaccagaacccaattgagagccatggctgccaagaccgtctgtccaccacacaaggttgaattggaagccttgttggaaaagcaagcctacaaggaacaagttttggctaagagattgaccatgttggaattgttggaaaagtacccagcctgcgaaatgaagttctctgaatttatcgccttgttgccatctatcagaccacgttactactctatttcttcctctccacgtgttgacgaaaagcaagcttctattactgtttccgttgtctccggtgaagcttggtccggttacggtgaatacaagggtattgcttctaactacttggctgaattgcaagaaggtgacaccattacttgtttcatctctactccacaatccgaatttactttgccaaaggacccagaaactccattgatcatggttggtccaggtactggtgtcgctccattcagaggtttcgttcaagctagaaaacaattgaaggaacaaggtcaatctttgggtgaagctcacttgtacttcggttgtagatctccacacgaagactacttataccaagaagaattggaaaacgctcaatccgaaggtattatcactttgcacaccgctttctccagaatgccaaaccaaccaaagacttacgtccaacacgttatggaacaagacggtaagaagttgattgaattgttggaccaaggtgctcacttctacatttgtggtgatggttctcaaatggctccagccgttgaagccactttgatgaagtcttacgctgatgttcaccaagtttccgaagccgatgctagattatggttgcaacaattggaagaaaaaggtcgttacgctaaggatgtctgggccggttga

SEQ ID NO: 143 - DNA, 3150 bp, Artificial Sequence
  Description of Artificial Sequence: Synthetic polynucleotide
atgaccatcaaagaaatgccacaacctaagactttcggtgaattgaagaatttgcctttgttgaacaccgataagccagttcaagctttgatgaagattgctgatgaattgggtgaaatcttcaagtttgaagctccaggtagagtcactagatacttgtcatctcaaagattgatcaaagaagcctgcgacgaatccagatttgataagaatttgtctcaagctttgaagttcgctagagattttgctggtgatggtttggttacttcttggactcacgaaaagaattggaagaaggcccataacattttgttgccatctttctcacaacaagccatgaagggttatcatgctatgatggttgatatcgccgttcaattggttcaaaagtgggaaagattgaacgccgatgaacatatcgaagtctctgaagatatgaccagattgaccttggataccattggtttgtgtggtttcaactacagattcaactccttctacagagatcaaccacatccattcatcatctctatggttagagctgcagatgaagtcatgaacaaattgcaaagagctaatccagacgatccagcttatgacgaaaacaagagacaattccaagaagatatcaaggtcatgaacgatttggtcgataagattatcgctgatagaaaggctagaggtgaacaatctgatgatttgttgacccaaatgttgaacggtaaggatccagaaactggtgaaccattggatgatggtaacatcagataccaaattatcgctttcttgattgctggtcacgaaactacatctggtttgttgtcttttgccttgtactttttggttaagaacccacacgtcttgcaaaaggttgctgaagaagctgcaagagttttggttgatccagttccatcttacaagcaagtcaagcaattgaagtacgttggtatggttttgaacgaagctttgagattgtggccaactgctccagctttttcattatacgctaaagaagataccgtcttgggtggtgaatatccattggaaaaaggtgatgaagttatggtcttgatcccacaattgcatagagataagactgtttggggtgatgatgtcgaagaattcagaccagaaagattcgaaaacccatctgctattccacaacatgcttttaagccatttggtaacggtcaaagagcttgcattggtcaacaattcgctttacatgaagctaccttggttttgggtatgatgttgaaacacttcgacttcgaagatcacaccaactacgaattggatatcaaagaaaccgctaccttgaagccaaagggttttgttgttaaggctaagtccaaaaagattccattgggtggtattccatctccatctactgaacaatccgctaagaaggttagaaagaaagctgaaaacgctcataacacacctttgttggtcttgtacggttctaatatgggtactgctgaaggtacagcaagagatttggcagatattgctatgtctaaaggtttcgctccacaagttgctactttggattctcatgctggtaatttgccaagagaaggtgctgttttgatagttactgcttcttacaatggtcacccaccagataatgctaagcaattcgttgattggttggatcaagcttcagctgatgaagtaaaaggtgttagatactctgttttcggttgcggtgacaaaaattgggctactacttatcaaaaggttccagcctttattgacgaaactttggctgctaaaggtgctgaaaacattgctgacagaggtgaagctgatgcctccgacgacttcgaaggtacttacgaagaatggagagaacacatgtggtctgacgttgctgcttacttcaacttggacatcgaaaactctgaagacaacaagtccactttgtctttgcaattcgttgactccgctgctgacatgccattggctaagatgcacggtgctttctctaccaacgtcgttgcctccaaggaattgcaacaaccaggttctgctagatctactagacacttggaaatcgaattgccaaaggaagcttcctaccaagaaggtgaccacttgggcgttattccaagaaactacgaaggtatcgtcaacagagttactgctagattcggtttggatgcttctcaacaaatcagattagaagctgaagaagaaaagttggctcacttgccattagctaagactgtctccgttgaagaattgttgcaatacgtcgaattgcaagacccagttaccagaacccaattgagagccatggctgccaagaccgtctgtccaccacacaaggttgaattggaagccttgttggaaaagcaagcctacaaggaacaagttttggctaagagattgaccatgttggaattgttggaaaagtacccagcctgcgaaatgaagttctctgaatttatcgccttgttgccatctatcagaccacgttactactctatttcttcctctccacgtgttgacgaaaagcaagcttctattactgtttccgttgtctccggtgaagcttggtccggttacggtgaatacaagggtattgcttctaactacttggctgaattgcaagaaggtgacaccattacttgtttcatctctactccacaatccgaatttactttgccaaaggacccagaaactccattgatcatggttggtccaggtactggtgtcgctccattcagaggtttcgttcaagctagaaaacaattgaaggaacaaggtcaatctttgggtgaagctcacttgtacttcggttgtagatctccacacgaagactacttataccaagaagaattggaaaacgctcaatccgaaggtattatcactttgcacaccgctttctccagaatgccaaaccaaccaaagacttacgtccaacacgttatggaacaagacggtaagaagttgattgaattgttggaccaaggtgctcacttctacatttgtggtgatggttctcaaatggctccagccgttgaagccactttgatgaagtcttacgctgatgttcaccaagtttccgaagccgatgctagattatggttgcaacaattggaagaaaaaggtcgttacgctaaggatgtctgggccggttga

SEQ ID NO: 144 - DNA, 3150 bp, Artificial Sequence
  Description of Artificial Sequence: Synthetic polynucleotide
atgaccatcaaagaaatgccacaacctaagactttcggtgaattgaagaatttgcctttgttgaacaccgataagccagttcaagctttgatgaagattgctgatgaattgggtgaaatcttcaagtttgaagctccaggtagagtcactagatacttgtcatctcaaagattgatcaaagaagcctgcgacgaatccagatttgataagaatttgtctcaagctgctaagttcgctagagattttgctggtgatggtttggttacttcttggactcacgaaaagaattggaagaaggcccataacattttgttgccatctttctcacaacaagccatgaagggttatcatgctatgatggttgatatcgccgttcaattggttcaaaagtgggaaagattgaacgccgatgaacatatcgaagtctctgaagatatgaccagattgaccttggataccattggtttgtgtggtttcaactacagattcaactccttctacagagatcaaccacatccattcatcatctctatggttagagctgcagatgaagtcatgaacaaattgcaaagagctaatccagacgatccagcttatgacgaaaacaagagacaattccaagaagatatcaaggtcatgaacgatttggtcgataagattatcgctgatagaaaggctagaggtgaacaatctgatgatttgttgacccaaatgttgaacggtaaggatccagaaactggtgaaccattggatgatggtaacatcagataccaaattatcaccttcttgattgctggtcacgaaactacatctggtttgttgtcttttgccttgtactttttggttaagaacccacacgtcttgcaaaaggttgctgaagaagctgcaagagttttggttgatccagttccatcttacaagcaagtcaagcaattgaagtacgttggtatggttttgaacgaagctttgagattgtggccaactgctccagctttttcattatacgctaaagaagataccgtcttgggtggtgaatatccattggaaaaaggtgatgaagttatggtcttgatcccacaattgcatagagataagactgtttggggtgatgatgtcgaagaattcagaccagaaagattcgaaaacccatctgctattccacaacatgcttttaagccatttggtaacggtcaaagagcttgcattggtcaacaattcgctttacatgaagctaccttggttttgggtatgatgttgaaacacttcgacttcgaagatcacaccaactacgaattggatatcaaagaaaccttgaccttgaagccaaagggttttgttgttaaggctaagtccaaaaagattccattgggtggtattccatctccatctactgaacaatccgctaagaaggttagaaagaaagctgaaaacgctcataacacacctttgttggtcttgtacggttctaatatgggtactgctgaaggtacagcaagagatttggcagatattgctatgtctaaaggtttcgctccacaagttgctactttggattctcatgctggtaatttgccaagagaaggtgctgttttgatagttactgcttcttacaatggtcacccaccagataatgctaagcaattcgttgattggttggatcaagcttcagctgatgaagtaaaaggtgttagatactctgttttcggttgcggtgacaaaaattgggctactacttatcaaaaggttccagcctttattgacgaaactttggctgctaaaggtgctgaaaacattgctgacagaggtgaagctgatgcctccgacgacttcgaaggtacttacgaagaatggagagaacacatgtggtctgacgttgctgcttacttcaacttggacatcgaaaactctgaagacaacaagtccactttgtctttgcaattcgttgactccgctgctgacatgccattggctaagatgcacggtgctttctctaccaacgtcgttgcctccaaggaattgcaacaaccaggttctgctagatctactagacacttggaaatcgaattgccaaaggaagcttcctaccaagaaggtgaccacttgggcgttattccaagaaactacgaaggtatcgtcaacagagttactgctagattcggtttggatgcttctcaacaaatcagattagaagctgaagaagaaaagttggctcacttgccattagctaagactgtctccgttgaagaattgttgcaatacgtcgaattgcaagacccagttaccagaacccaattgagagccatggctgccaagaccgtctgtccaccacacaaggttgaattggaagccttgttggaaaagcaagcctacaaggaacaagttttggctaagagattgaccatgttggaattgttggaaaagtacccagcctgcgaaatgaagttctctgaatttatcgccttgttgccatctatcagaccacgttactactctatttcttcctctccacgtgttgacgaaaagcaagcttctattactgtttccgttgtctccggtgaagcttggtccggttacggtgaatacaagggtattgcttctaactacttggctgaattgcaagaaggtgacaccattacttgtttcatctctactccacaatccgaatttactttgccaaaggacccagaaactccattgatcatggttggtccaggtactggtgtcgctccattcagaggtttcgttcaagctagaaaacaattgaaggaacaaggtcaatctttgggtgaagctcacttgtacttcggttgtagatctccacacgaagactacttataccaagaagaattggaaaacgctcaatccgaaggtattatcactttgcacaccgctttctccagaatgccaaaccaaccaaagacttacgtccaacacgttatggaacaagacggtaagaagttgattgaattgttggaccaaggtgctcacttctacatttgtggtgatggttctcaaatggctccagccgttgaagccactttgatgaagtcttacgctgatgttcaccaagtttccgaagccgatgctagattatggttgcaacaattggaagaaaaaggtcgttacgctaaggatgtctgggccggttga

SEQ ID NO: 145 - DNA, 3150 bp, Artificial Sequence
  Description of Artificial Sequence: Synthetic polynucleotide
atgaccatcaaagaaatgccacaacctaagactttcggtgaattgaagaatttgcctttgttgaacaccgataagccagttcaagctttgatgaagattgctgatgaattgggtgaaatcttcaagtttgaagctccaggtagagtcactagatacttgtcatctcaaagattgatcaaagaagcctgcgacgaatccagatttgataagaatttgtctcaagctgctaagttcgctagagattttgctggtgatggtttggttacttcttggactcacgaaaagaattggaagaaggcccataacattttgttgccatctttctcacaacaagccatgaagggttatcatgctatgatggttgatatcgccgttcaattggttcaaaagtgggaaagattgaacgccgatgaacatatcgaagtctctgaagatatgaccagattgaccttggataccattggtttgtgtggtttcaactacagattcaactccttctacagagatcaaccacatccattcatcatctctgctgttagagctgcagatgaagtcatgaacaaattgcaaagagctaatccagacgatccagcttatgacgaaaacaagagacaattccaagaagatatcaaggtcatgaacgatttggtcgataagattatcgctgatagaaaggctagaggtgaacaatctgatgatttgttgacccaaatgttgaacggtaaggatccagaaactggtgaaccattggatgatggtaacatcagataccaaattatcaccttcttgattgctggtcacgaaactacatctggtttgttgtcttttgccttgtactttttggttaagaacccacacgtcttgcaaaaggttgctgaagaagctgcaagagttttggttgatccagttccatcttacaagcaagtcaagcaattgaagtacgttggtatggttttgaacgaagctttgagattgtggccaactgctccagctttttcattatacgctaaagaagataccgtcttgggtggtgaatatccattggaaaaaggtgatgaagttatggtcttgatcccacaattgcatagagataagactgtttggggtgatgatgtcgaagaattcagaccagaaagattcgaaaacccatctgctattccacaacatgcttttaagccatttggtaacggtcaaagagcttgcattggtcaacaattcgctttacatgaagctaccttggttttgggtatgatgttgaaacacttcgacttcgaagatcacaccaactacgaattggatatcaaagaaaccttgaccttgaagccaaagggttttgttgttaaggctaagtccaaaaagattccattgggtggtattccatctccatctactgaacaatccgctaagaaggttagaaagaaagctgaaaacgctcataacacacctttgttggtcttgtacggttctaatatgggtactgctgaaggtacagcaagagatttggcagatattgctatgtctaaaggtttcgctccacaagttgctactttggattctcatgctggtaatttgccaagagaaggtgctgttttgatagttactgcttcttacaatggtcacccaccagataatgctaagcaattcgttgattggttggatcaagcttcagctgatgaagtaaaaggtgttagatactctgttttcggttgcggtgacaaaaattgggctactacttatcaaaaggttccagcctttattgacgaaactttggctgctaaaggtgctgaaaacattgctgacagaggtgaagctgatgcctccgacgacttcgaaggtacttacgaagaatggagagaacacatgtggtctgacgttgctgcttacttcaacttggacatcgaaaactctgaagacaacaagtccactttgtctttgcaattcgttgactccgctgctgacatgccattggctaagatgcacggtgctttctctaccaacgtcgttgcctccaaggaattgcaacaaccaggttctgctagatctactagacacttggaaatcgaattgccaaaggaagcttcctaccaagaaggtgaccacttgggcgttattccaagaaactacgaaggtatcgtcaacagagttactgctagattcggtttggatgcttctcaacaaatcagattagaagctgaagaagaaaagttggctcacttgccattagctaagactgtctccgttgaagaattgttgcaatacgtcgaattgcaagacccagttaccagaacccaattgagagccatggctgccaagaccgtctgtccaccacacaaggttgaattggaagccttgttggaaaagcaagcctacaaggaacaagttttggctaagagattgaccatgttggaattgttggaaaagtacccagcctgcgaaatgaagttctctgaatttatcgccttgttgccatctatcagaccacgttactactctatttcttcctctccacgtgttgacgaaaagcaagcttctattactgtttccgttgtctccggtgaagcttggtccggttacggtgaatacaagggtattgcttctaactacttggctgaattgcaagaaggtgacaccattacttgtttcatctctactccacaatccgaatttactttgccaaaggacccagaaactccattgatcatggttggtccaggtactggtgtcgctccattcagaggtttcgttcaagctagaaaacaattgaaggaacaaggtcaatctttgggtgaagctcacttgtacttcggttgtagatctccacacgaagactacttataccaagaagaattggaaaacgctcaatccgaaggtattatcactttgcacaccgctttctccagaatgccaaaccaaccaaagacttacgtccaacacgttatggaacaagacggtaagaagttgattgaattgttggaccaaggtgctcacttctacatttgtggtgatggttctcaaatggctccagccgttgaagccactttgatgaagtcttacgctgatgttcaccaagtttccgaagccgatgctagattatggttgcaacaattggaagaaaaaggtcgttacgctaaggatgtctgggccggttga

SEQ ID NO: 146 - DNA, 3150 bp, Artificial Sequence
  Description of Artificial Sequence: Synthetic polynucleotide
atgaccatcaaagaaatgccacaacctaagactttcggtgaattgaagaatttgcctttgttgaacaccgataagccagttcaagctttgatgaagattgctgatgaattgggtgaaatcttcaagtttgaagctccaggtagagtcactagatacttgtcatctcaaagattgatcaaagaagcctgcgacgaatccagatttgataagaatttgtctcaagctgctaagttcgctagagattttgctggtgatggtttggttacttcttggactcacgaaaagaattggaagaaggcccataacattttgttgccatctttctcacaacaagccatgaagggttatcatgctatgatggttgatatcgccgttcaattggttcaaaagtgggaaagattgaacgccgatgaacatatcgaagtctctgaagatatgaccagattgaccttggataccattggtttgtgtggtttcaactacagattcaactccttctacagagatcaaccacatccattcatcatctctgctgttagagctgcagatgaagtcatgaacaaattgcaaagagctaatccagacgatccagcttatgacgaaaacaagagacaattccaagaagatatcaaggtcatgaacgatttggtcgataagattatcgctgatagaaaggctagaggtgaacaatctgatgatttgttgacccaaatgttgaacggtaaggatccagaaactggtgaaccattggatgatggtaacatcagataccaaattatcgctttcttgattgctggtcacgaaactacatctggtttgttgtcttttgccttgtactttttggttaagaacccacacgtcttgcaaaaggttgctgaagaagctgcaagagttttggttgatccagttccatcttacaagcaagtcaagcaattgaagtacgttggtatggttttgaacgaagctttgagattgtggccaactgctccagctttttcattatacgctaaagaagataccgtcttgggtggtgaatatccattggaaaaaggtgatgaagttatggtcttgatcccacaattgcatagagataagactgtttggggtgatgatgtcgaagaattcagaccagaaagattcgaaaacccatctgctattccacaacatgcttttaagccatttggtaacggtcaaagagcttgcattggtcaacaattcgctttacatgaagctaccttggttttgggtatgatgttgaaacacttcgacttcgaagatcacaccaactacgaattggatatcaaagaaaccttgaccttgaagccaaagggttttgttgttaaggctaagtccaaaaagattccattgggtggtattccatctccatctactgaacaatccgctaagaaggttagaaagaaagctgaaaacgctcataacacacctttgttggtcttgtacggttctaatatgggtactgctgaaggtacagcaagagatttggcagatattgctatgtctaaaggtttcgctccacaagttgctactttggattctcatgctggtaatttgccaagagaaggtgctgttttgatagttactgcttcttacaatggtcacccaccagataatgctaagcaattcgttgattggttggatcaagcttcagctgatgaagtaaaaggtgttagatactctgttttcggttgcggtgacaaaaattgggctactacttatcaaaaggttccagcctttattgacgaaactttggctgctaaaggtgctgaaaacattgctgacagaggtgaagctgatgcctccgacgacttcgaaggtacttacgaagaatggagagaacacatgtggtctgacgttgctgcttacttcaacttggacatcgaaaactctgaagacaacaagtccactttgtctttgcaattcgttgactccgctgctgacatgccattggctaagatgcacggtgctttctctaccaacgtcgttgcctccaaggaattgcaacaaccaggttctgctagatctactagacacttggaaatcgaattgccaaaggaagcttcctaccaagaaggtgaccacttgggcgttattccaagaaactacgaaggtatcgtcaacagagttactgctagattcggtttggatgcttctcaacaaatcagattagaagctgaagaagaaaagttggctcacttgccattagctaagactgtctccgttgaagaattgttgcaatacgtcgaattgcaagacccagttaccagaacccaattgagagccatggctgccaagaccgtctgtccaccacacaaggttgaattggaagccttgttggaaaagcaagcctacaaggaacaagttttggctaagagattgaccatgttggaattgttggaaaagtacccagcctgcgaaatgaagttctctgaatttatcgccttgttgccatctatcagaccacgttactactctatttcttcctctccacgtgttgacgaaaagcaagcttctattactgtttccgttgtctccggtgaagcttggtccggttacggtgaatacaagggtattgcttctaactacttggctgaattgcaagaaggtgacaccattacttgtttcatctctactccacaatccgaatttactttgccaaaggacccagaaactccattgatcatggttggtccaggtactggtgtcgctccattcagaggtttcgttcaagctagaaaacaattgaaggaacaaggtcaatctttgggtgaagctcacttgtacttcggttgtagatctccacacgaagactacttataccaagaagaattggaaaacgctcaatccgaaggtattatcactttgcacaccgctttctccagaatgccaaaccaaccaaagacttacgtccaacacgttatggaacaagacggtaagaagttgattgaattgttggaccaaggtgctcacttctacatttgtggtgatggttctcaaatggctccagccgttgaagccactttgatgaagtcttacgctgatgttcaccaagtttccgaagccgatgctagattatggttgcaacaattggaagaaaaaggtcgttacgctaaggatgtctgggccggttga

SEQ ID NO: 147 - DNA, 5372 bp, Artificial Sequence
  Description of Artificial Sequence: Synthetic polynucleotide
cctcgccgcagttaattaaagtcagtgagcgaggaagcgcgtaactataacggtcctaaggtagcgaatcctgatgcggtattttctccttacgcatctgtgcggtatttcacaccgcatagatcggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctttcggggctctcttgccttccaacccagtcagaaatcgagttccaatccaaaagttcacctgtcccacctgcttctgaatcaaacaagggaataaacgaatgaggtttctgtgaagctgcactgagtagtatgttgcagtcttttggaaatacgagtcttttaataactggcaaaccgaggaactcttggtattcttgccacgactcatctccatgcagtggagccaatcaattcttgcggtcaactttggacgatatcaatgccgtaatcattgaccagagccaaaacatcctccttaagttgattacgaaacacgccaaccaagtatttcggagtgcctgaactatttttatatgcttttacaagacttgaaattttccttgcaataaccgggtcaattgttctctttctattgggcacacatataatacccagcaagtcagcatcggaatctagagcacattctgcggcctctgtgctctgcaagccgcaaactttcaccaatggaccagaactacctgtgaaattaataacagacatactccaagctgcctttgtgtgcttaatcacgtatactcacgtgctcaatagtcaccaatgccctccctcttggccctctccttttcttttttcgaccgaattaattcttaatcggcaaaaaaagaaaagctccggatcaagattgtacgtaaggtgacaagctatttttcaataaagaatatcttccactactgccatctggcgtcataactgcaaagtacacatatattacgatgctgttctattaaatgcttcctatattatatatatagtaatgtcgtgatctatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaaggtgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggacgcgtagtctagaccagccaggacagaaatgcctcgacttcgctgctacccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacattatgagggaagcggtgatcgccgaagtatcgactcaactatcagaggtagttggcgccatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccggctgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagcattcaaggcgccttgattatttgacgtggtttgatggcctccacgcacgttgtgatatgtagatgattcagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaaacaggccccttttcctttgtcgatatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgtaatcattatcactttacgggtcctttccggtgatccgacaggttacggggcggcgacctcgcgggttttcgctatttatgaaaattttccggtttaaggcgtttccgttcttcttcgtcataacttaatgtttttatttaaaatacctcgcgagtggcaacactgaaaatacccatggagcggcgtaaccgtcgcacaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcagtggaacgtgcattatgaattagttacgctagggataacagggtaatatagaacccgaacgaccgagcgcagcggcggccgcgctgataccgccgc

SEQ ID NO: 148 - DNA, 4977 bp, Artificial Sequence
  Description of Artificial Sequence: Synthetic polynucleotide
aacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcagtggaacgtgcattatgaattagttacgctagggataacagggtaatatagaacccgaacgaccgagcgcagcggcggccgcgctgataccgccgccctcgccgcagttaattaaagtcagtgagcgaggaagcgcgtaactataacggtcctaaggtagcgaatcctgatgcggtattttctccttacgcatctgtgcggtatttcacaccgcatagatcggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctttcggggctctcttgccttccaacccagtcagaaatcgagttccaatccaaaagttcacctgtcccacctgcttctgaatcaaacaagggaataaacgaatgaggtttctgtgaagctgcactgagtagtatgttgcagtcttttggaaatacgagtcttttaataactggcaaaccgaggaactcttggtattcttgccacgactcatctccatgcagtggagccaatcaattcttgcggtcaactttggacgatatcaatgccgtaatcattgaccagagccaaaacatcctccttaagttgattacgaaacacgccaaccaagtatttcggagtgcctgaactatttttatatgcttttacaagacttgaaattttccttgcaataaccgggtcaattgttctctttctattgggcacacatataatacccagcaagtcagcatcggaatctagagcacattctgcggcctctgtgctctgcaagccgcaaactttcaccaatggaccagaactacctgtgaaattaataacagacatactccaagctgcctttgtgtgcttaatcacgtatactcacgtgctcaatagtcaccaatgccctccctcttggccctctccttttcttttttcgaccgaattaattcttaatcggcaaaaaaagaaaagctccggatcaagattgtacgtaaggtgacaagctatttttcaataaagaatatcttccactactgccatctggcgtcataactgcaaagtacacatatattacgatgctgttctattaaatgcttcctatattatatatatagtaatgtcgtgatctatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaaggtgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggacgcgtagtctagaccagccaggacagaaatgcctcgacttcgctgctacccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacattatgagggaagcggtgatcgccgaagtatcgactcaactatcagaggtagttggcgccatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccggctgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagcattcaaggcgccttgattatttgacgtggtttgatggcctccacgcacgttgtgatatgtagatgagagcgttggttggtggatcaagcccacgcgtaggcaatcctcgagcagatccgccaggcgtgtatatatagcgtggatggccaggcaactttagtgctgacacatacaggcatatatatatgtgtgcgacaacacatgatcatatggcatgcatgtgctctgtatgtatataaaactcttgttttcttcttttctctaaatattctttccttatacattaggacctttgcagcataaattactatacttctatagacacacaaacacaaatacacacactaaattaataacaggccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacaaacgcgtgtacgcatgtaacattatactgaaaaccttgcttgagaaggttttgggacgctcgaaggctttaatttgtaatcattatcactttacgggtcctttccggtgatccgacaggttacggggcggcgacctcgcgggttttcgctatttatgaaaattttccggtttaaggcgtttccgttcttcttcgtcataacttaatgtttttatttaaaatacctcgcgagtggcaacactgaaaatacccatggagcggcgtaaccgtcgcacaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcg

SEQ ID NO: 149 - DNA, 5079 bp, Artificial Sequence
  Description of Artificial Sequence: Synthetic polynucleotide
acgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcagtggaacgtgcattatgaattagttacgctagggataacagggtaatatagaacccgaacgaccgagcgcagcggcggccgcgctgataccgccgccctcgccgcagttaattaaagtcagtgagcgaggaagcgcgtaactataacggtcctaaggtagcgaatcctgatgcggtattttctccttacgcatctgtgcggtatttcacaccgcatagatcggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctttcggggctctcttgccttccaacccagtcagaaatcgagttccaatccaaaagttcacctgtcccacctgcttctgaatcaaacaagggaataaacgaatgaggtttctgtgaagctgcactgagtagtatgttgcagtcttttggaaatacgagtcttttaataactggcaaaccgaggaactcttggtattcttgccacgactcatctccatgcagtggagccaatcaattcttgcggtcaactttggacgatatcaatgccgtaatcattgaccagagccaaaacatcctccttaagttgattacgaaacacgccaaccaagtatttcggagtgcctgaactatttttatatgcttttacaagacttgaaattttccttgcaataaccgggtcaattgttctctttctattgggcacacatataatacccagcaagtcagcatcggaatctagagcacattctgcggcctctgtgctctgcaagccgcaaactttcaccaatggaccagaactacctgtgaaattaataacagacatactccaagctgcctttgtgtgcttaatcacgtatactcacgtgctcaatagtcaccaatgccctccctcttggccctctccttttcttttttcgaccgaattaattcttaatcggcaaaaaaagaaaagctccggatcaagattgtacgtaaggtgacaagctatttttcaataaagaatatcttccactactgccatctggcgtcataactgcaaagtacacatatattacgatgctgttctattaaatgcttcctatattatatatatagtaatgtcgtgatctatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaaggtgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggacgcgtagtctagaccagccaggacagaaatgcctcgacttcgctgctacccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacattatgagggaagcggtgatcgccgaagtatcgactcaactatcagaggtagttggcgccatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccggctgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagcattcaaggcgccttgattatttgacgtggtttgatggcctccacgcacgttgtgatatgtagatgactcgtaggaacaatttcgggcccctgcgtgttcttctgaggttcatcttttacatttgcttctgctggataattttcagaggcaacaaggaaaaattagatggcaaaaagtcgtctttcaaggaaaaatccccaccatctttcgagatcccctgtaacttattggcaactgaaagaatgaaaaggaggaaaatacaaaatatactagaactgaaaaaaaaaaagtataaatagagacgatatatgccaatacttcacaatgttcgaatctattcttcatttgcagctattgtaaaataataaaacatcaagaacaaacaagctcaacttgtcttttctaagaacaaagaataaacacaaaaacaaaaagtttttttaattttaatcaaaaaacaggccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacaaacgcgtgtacgcatgtaacattatactgaaaaccttgcttgagaaggttttgggacgctcgaaggctttaatttgtaatcattatcactttacgggtcctttccggtgatccgacaggttacggggcggcgacctcgcgggttttcgctatttatgaaaattttccggtttaaggcgtttccgttcttcttcgtcataacttaatgtttttatttaaaatacctcgcgagtggcaacactgaaaatacccatggagcggcgtaaccgtcgcacaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcga

SEQ ID NO: 150 - protein, 21 aa, Papaver rhoeas
TQGLMSYKVVPLDILLTRRML

SEQ ID NO: 151 - protein, 60 aa, Artificial Sequence
  Description of Artificial Sequence: Synthetic polypeptide
TPGLMSYKVVPLDILLTHRRIKSCVQLASSERDMESSGVPVITLSSGKVMPVLGMGTFEK

SEQ ID NO: 152 - protein, 27 aa, Papaver rhoeas
MDSSGVPVIPLSSGKGMPALALGTFET

SEQ ID NO: 153 - protein, 900 aa, Artificial Sequence
  Description of Artificial Sequence: Synthetic polypeptide
MELQYISYFQPTSSVVALLLALVSILSSVVVLRKTFLNNYSSSPASSTKTAVLSHQRQQSCALPISGLLHIFMNKNGLIHVTLGNMADKYGPIFSFPTGSHRTLVVSSWEMVKECFTGNNDTAFSNRPIPLAFKTIFYACGGIDSYGLSSVPYGKYWRELRKVCVHNLLSNQQLLKFRHLIISQVDTSFNKLYELCKNSEDNQGNYPTTTTAAGMVRIDDWLAELSFNVIGRIVCGFQSGPKTGAPSRVEQFKEAINEASYFMSTSPVSDNVPMLGWIDQLTGLTRNMKHCGKKLDLVVESIINDHRQKRRFSRTKGGDEKDDEQDDFIDICLSIMEQPQLPGNNNPSQIPIKSIVLDMIGGGTDTTKLTTIWTLSLLLNNPHVLDKAKQEVDAHFRTKRRSTNDAAAAVVDFDDIRNLVYIQAIIKESMRLYPASPVVERLSGEDCVVGGFHVPAGTRLWANVWKMQRDPKVWDDPLVFRPDRFLSDEQKMVDVRGQNYELLPFGAGRRVCPGVSFSLDLMQLVLTRLILEFEMKSPSGKVDMTATPGLMSYKVIPLDILLTHRRIKPCVQSAASERDMESSGVPVITLGSGKVMPVLGMGTFEKVGKGSERERLAILKAIEVGYRYFDTAAAYETEEVLGEAIAEALQLGLVKSRDELFISSMLWCTDAHADRVLLALQNSLRNLKLEYVDLYMLPFPASLKPGKITMDIPEEDICRMDYRSVWAAMEECQNLGFTKSIGVSNFSCKKLQELMATANIPPAVNQVEMSPAFQQKKLREYCNANNILVSAISVLGSNGTPWGSNAVLGSEVLKKIAMAKGKSVAQVSMRWVYEQGASLVVKSFSEERLRENLNIFDWELTKEDHEKIGEIPQCRILSAYFLVSPNGPFKSQEELWDDEA

What is claimed is:

1. A method of increasing production of an alkaloid product through the epimerization of a (S)-1-benzylisoquinoline alkaloid to a (R)-1-benyzlisoquinoline alkaloid via an engineered split epimerase in an engineered host cell in comparison to the epimerization of a (S)-1-benzylisoquinoline alkaloid to a (R)-1-benyzlisoquinoline alkaloid via a fused epimerase in similar conditions, said method comprising:
   contacting said (S)-1-benzylisoquinoline alkaloid with said engineered split epimerase in said engineered host cell, thereby increasing production of an alkaloid product,
   wherein contacting said (S)-1-benzylisoquinoline alkaloid with said engineered split epimerase converts said (S)-1-benzylisoquinoline alkaloid to said (R)-1-benzylisoquinoline alkaloid within said engineered host cell, wherein contacting said (S)-1-benzylisoquinoline alkaloid with said engineered split epimerase increases production of the (R)-1-benyzlisoquinoline alkaloid as compared to the epimerization of a (S)-1-benzylisoquinoline alkaloid to a (R)-1-benyzlisoquinoline alkaloid via a fused epimerase in similar conditions, and
   wherein said engineered split epimerase comprises an oxidase component and a reductase component, wherein said oxidase component of said engineered split epimerase comprises a first molecule, and a reductase component of said same engineered split epimerase comprises a second molecule, and wherein said oxidase component of said engineered split epimerase is separate from said reductase component of said same engineered split epimerase.

2. The method of claim 1, wherein said fused epimerase is a wildtype epimerase.

3. The method of claim 1, wherein said fused epimerase is a parent epimerase of said engineered split epimerase.

4. The method of claim 1, wherein said fused epimerase is an engineered fused epimerase comprising an oxidase domain with a same sequence as said oxidase component of said engineered split epimerase.

5. The method of claim 1, wherein said engineered split epimerase comprises one or more mutations that increase activity of said engineered split epimerase.

6. The method of claim 1, wherein said engineered split epimerase comprises one or more mutations selected from the group consisting of a localization mutation, a cytochrome P450 reductase interaction mutation, and an accessibility mutation.

7. The method of claim 1, wherein a first nucleic acid which encodes said oxidase component has a first translation initiation site and wherein a second nucleic acid which encodes said reductase component has a second translation initiation site.

8. The method of claim 1, wherein said oxidase component comprises a sequence that is encoded by a DNA sequence which comprises one or more mutations, each mutation at a codon position which corresponds to a position selected from the group consisting of positions 16, 17, 37, 50, 64, 69, 70, 110, 128, 155, 232, 234, 244, 293, 303, 328, 354, 387, 393, 427, and 477 within SEQ ID NO. 17.

9. The method of claim 1, wherein said oxidase component comprises a sequence having at least 80% sequence identity to SEQ ID NO. 17.

10. The method of claim 1, wherein said oxidase component comprises a sequence having at least 95% sequence identity to SEQ ID NO. 17.

11. The method of claim 1, wherein said oxidase component comprises a sequence that is encoded by a DNA sequence which comprises one or more codon substitutions, relative to a wildtype sequence, at a codon position which corresponds to an amino acid position in SEQ ID NO. 17 selected from the group consisting of position 75, 160, 191, 256, 359, 366, and 500.

12. The method of claim 1, wherein said reductase component comprises a sequence having at least 80% sequence identity to SEQ ID NO. 18.

13. The method of claim 1, wherein said reductase component comprises a sequence having at least 95% sequence identity to SEQ ID NO. 18.

14. The method of claim 1, wherein said engineered split epimerase produces at least 1% more of said (R)-1-benzylisoquinoline alkaloid than said fused epimerase under similar conditions.

15. The method of claim 1, wherein said engineered split epimerase produces at least 5% more of said (R)-1-benzylisoquinoline alkaloid than a wildtype fused epimerase under similar conditions.

16. A method of producing an alkaloid product through the epimerization of a (S)-1-benzylisoquinoline alkaloid to a (R)-1-benyzlisoquinoline alkaloid via an engineered split epimerase in an engineered host cell said method comprising:
   contacting said (S)-1-benzylisoquinoline alkaloid with said engineered split epimerase in said engineered host cell, thereby increasing production of an alkaloid product,
   wherein contacting said (S)-1-benzylisoquinoline alkaloid with said engineered split epimerase converts said (S)-1-benzylisoquinoline alkaloid to said (R)-1-benzylisoquinoline alkaloid within said engineered host cell, wherein said engineered split epimerase comprises an oxidase component and a reductase component, wherein said oxidase component comprises a sequence having at least 80% sequence identity to SEQ ID NO. 17, and wherein said reductase component comprises a sequence having at least 80% sequence identity to SEQ ID NO. 18, and wherein said oxidase component of said engineered split epimerase comprises a first molecule, and a reductase component of said same engineered split epimerase comprises a second molecule, and wherein said oxidase component of said engineered split epimerase is separate from said reductase component of said same engineered split epimerase.

17. The method of claim 16, wherein said engineered split epimerase comprises one or more mutations that increase activity of said engineered split epimerase.

18. The method of claim 16, wherein said engineered split epimerase comprises one or more mutations selected from the group consisting of a localization mutation, a cytochrome P450 reductase interaction mutation, and an accessibility mutation.

19. The method of claim 16, wherein a first nucleic acid which encodes said oxidase component has a first translation initiation site and wherein a second nucleic acid which encodes said reductase component has a second translation initiation site.

20. The method of claim 16, wherein said oxidase component comprises a sequence that is encoded by a DNA sequence which comprises one or more mutations, each mutation at a codon position which corresponds to a position selected from the group consisting of positions 16, 17, 37, 50, 64, 69, 70, 110, 128, 155, 232, 234, 244, 293, 303, 328, 354, 387, 393, 427, and 477 within SEQ ID NO. 17.

21. The method of claim 16, wherein said oxidase component comprises a sequence having at least 85% sequence identity to SEQ ID NO. 17.

22. The method of claim 16, wherein said oxidase component comprises a sequence having at least 95% sequence identity to SEQ ID NO. 17.

23. The method of claim 16, wherein said oxidase component comprises a sequence that is encoded by a DNA sequence which comprises one or more codon substitutions, relative to a wildtype sequence, at a codon position which corresponds to an amino acid position in SEQ ID NO. 17 selected from the group consisting of position 75, 160, 191, 256, 359, 366, and 500.

24. The method of claim 16, wherein said reductase component comprises a sequence having at least 85% sequence identity to SEQ ID NO. 18.

25. The method of claim 16, wherein said reductase component comprises a sequence having at least 90% sequence identity to SEQ ID NO. 18.

26. The method of claim 16, wherein said reductase component comprises a sequence having at least 95% sequence identity to SEQ ID NO. 18.

27. The method of claim 1, wherein said first molecule has a net oxidase activity and wherein said second molecule has a net reductase activity.

28. The method of claim 1, wherein the product of said first molecule comprises the substrate of said second molecule.

29. The method of claim 16, wherein said first molecule has a net oxidase activity and wherein said second molecule has a net reductase activity.

30. The method of claim 16, wherein the product of said first molecule comprises the substrate of said second molecule.

* * * * *